United States Patent
Nash et al.

(10) Patent No.: US 9,206,223 B2
(45) Date of Patent: Dec. 8, 2015

(54) METHODS FOR PREPARING PURIFIED POLYPEPTIDE COMPOSITIONS

(75) Inventors: Huw M. Nash, Concord, MA (US); Matthew Iadanza, Somerville, MA (US); Christopher Leitheiser, Arlington, MA (US); Noriyuki Kawahata, West Roxbury, MA (US)

(73) Assignee: AILERON THERAPEUTICS, INC., Cambridge, MA (US)

( * ) Notice: Subject to any disclaimer, the term of this patent is extended or adjusted under 35 U.S.C. 154(b) by 664 days.

(21) Appl. No.: 12/564,909

(22) Filed: Sep. 22, 2009

(65) Prior Publication Data

US 2010/0210515 A1 Aug. 19, 2010

Related U.S. Application Data

(60) Provisional application No. 61/099,099, filed on Sep. 22, 2008.

(51) Int. Cl.
*A61K 38/00* (2006.01)
*C07K 1/00* (2006.01)
*C07K 1/107* (2006.01)

(52) U.S. Cl.
CPC *C07K 1/107* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 4,730,006 A | 3/1988 | Bohme et al. | |
| 5,094,951 A * | 3/1992 | Rosenberg | 435/190 |
| 5,120,859 A | 6/1992 | Webb | |
| 5,364,851 A | 11/1994 | Joran | |
| 5,446,128 A | 8/1995 | Kahn et al. | |
| 5,622,852 A | 4/1997 | Korsmeyer | |
| 5,663,316 A | 9/1997 | Xudong | |
| 5,672,584 A | 9/1997 | Borchardt et al. | |
| 5,708,136 A | 1/1998 | Burrell et al. | |
| 5,750,767 A | 5/1998 | Carpino et al. | |
| 5,811,515 A | 9/1998 | Grubbs et al. | |
| 5,824,483 A | 10/1998 | Houston, Jr. et al. | |
| 5,834,209 A | 11/1998 | Korsmeyer | |
| 5,856,445 A | 1/1999 | Korsmeyer | |
| 5,874,529 A | 2/1999 | Gilon et al. | |
| 5,922,863 A | 7/1999 | Grubbs et al. | |
| 5,955,593 A | 9/1999 | Korsmeyer | |
| 5,965,703 A | 10/1999 | Horne et al. | |
| 5,998,583 A | 12/1999 | Korsmeyer | |
| 6,030,997 A | 2/2000 | Eilat et al. | |
| 6,043,339 A | 3/2000 | Lin et al. | |
| 6,046,289 A | 4/2000 | Komazawa et al. | |
| 6,051,554 A | 4/2000 | Hornik et al. | |
| 6,153,391 A | 11/2000 | Picksley et al. | |
| 6,184,344 B1 | 2/2001 | Kent et al. | |
| 6,271,198 B1 | 8/2001 | Braisted et al. | |
| 6,326,354 B1 | 12/2001 | Gross et al. | |
| 6,348,558 B1 | 2/2002 | Harris et al. | |
| 6,495,674 B1 | 12/2002 | Lemke et al. | |
| 6,569,993 B1 | 5/2003 | Sledeski et al. | |
| 6,610,657 B1 | 8/2003 | Goueli | |
| 6,613,874 B1 | 9/2003 | Mazur et al. | |
| 6,703,382 B2 | 3/2004 | Wang et al. | |
| 6,713,280 B1 | 3/2004 | Huang et al. | |
| 6,875,594 B2 | 4/2005 | Muir et al. | |
| 7,064,193 B1 | 6/2006 | Cory et al. | |
| 7,083,983 B2 | 8/2006 | Lane et al. | |
| 7,084,244 B2 | 8/2006 | Gilon et al. | |
| 7,183,059 B2 | 2/2007 | Verdine et al. | |
| 7,192,713 B1 | 3/2007 | Verdine et al. | |
| 7,202,332 B2 | 4/2007 | Arora et al. | |
| 7,247,700 B2 | 7/2007 | Korsemeyer et al. | |
| 7,538,190 B2 | 5/2009 | Robinson et al. | |
| 7,705,118 B2 | 4/2010 | Arora et al. | |
| 7,723,469 B2 | 5/2010 | Walensky et al. | |
| 7,745,573 B2 | 6/2010 | Robinson et al. | |
| 7,786,072 B2 | 8/2010 | Verdine et al. | |
| 7,981,999 B2 | 7/2011 | Nash | |
| 8,071,541 B2 | 12/2011 | Arora et al. | |
| 8,124,726 B2 | 2/2012 | Robinson et al. | |
| 8,198,405 B2 | 6/2012 | Walensky et al. | |
| 8,324,428 B2 | 12/2012 | Verdine | |
| 2004/0023887 A1 | 2/2004 | Pillutla et al. | |
| 2004/0038901 A1 | 2/2004 | Basler et al. | |
| 2004/0067503 A1 | 4/2004 | Tan et al. | |
| 2004/0115135 A1 | 6/2004 | Quay | |
| 2004/0171809 A1 | 9/2004 | Korsemeyer et al. | |
| 2004/0235746 A1 | 11/2004 | Hawiger et al. | |

(Continued)

FOREIGN PATENT DOCUMENTS

| | | |
|---|---|---|
| CN | 1906209 A | 1/2007 |
| JP | 2002-524391 | 8/2002 |

(Continued)

OTHER PUBLICATIONS

The Journal of Organic Chemistry (2001) vol. 66, Issue: 16, Publisher: American Chemical Society, pp. 5291-5302 Blackwell et al.*
Cho and Kim American Chemical Society 2003.*
Cho, et al. An efficient method for removal of ruthenium byproducts from olefin metathesis reactions. Org Lett. Feb. 20, 2003;5(4):531-3.
Hong, et al. Efficient removal of ruthenium byproducts from olefin metathesis products by simple aqueous extraction. Org Lett. May 10, 2007;9(10):1955-7.
International search report dated Mar. 17, 2010 for PCT Application No. US2009-057931.

(Continued)

*Primary Examiner* — Karlheinz R Skowronek
*Assistant Examiner* — Li Lee
(74) *Attorney, Agent, or Firm* — Wilson Sonsini Goodrich & Rosati

(57) ABSTRACT

The present invention relates to purified peptidomimetic macrocycles. The invention additionally provides methods of preparing and using such macrocycles, for example in therapeutic applications.

47 Claims, No Drawings

(56) References Cited

U.S. PATENT DOCUMENTS

| | | | |
|---|---|---|---|
| 2005/0250680 A1* | 11/2005 | Walensky et al. | 514/9 |
| 2006/0008848 A1 | 1/2006 | Verdine et al. | |
| 2006/0014675 A1 | 1/2006 | Arora et al. | |
| 2008/0262200 A1 | 10/2008 | Nash | |
| 2009/0047711 A1 | 2/2009 | Nash | |
| 2009/0088553 A1 | 4/2009 | Nash | |
| 2009/0149630 A1 | 6/2009 | Walensky et al. | |
| 2009/0176964 A1 | 7/2009 | Walensky et al. | |
| 2009/0326192 A1 | 12/2009 | Nash et al. | |
| 2010/0184628 A1 | 7/2010 | Nash | |
| 2010/0184645 A1 | 7/2010 | Verdine et al. | |
| 2010/0216688 A1 | 8/2010 | Nash et al. | |
| 2010/0234563 A1 | 9/2010 | Arora et al. | |
| 2010/0298201 A1 | 11/2010 | Nash et al. | |
| 2011/0028753 A1 | 2/2011 | Verdine et al. | |
| 2011/0144303 A1 | 6/2011 | Nash et al. | |
| 2011/0223149 A1 | 9/2011 | Nash et al. | |
| 2011/0263815 A1 | 10/2011 | Nash | |
| 2012/0172311 A1 | 7/2012 | Nash et al. | |
| 2013/0023646 A1 | 1/2013 | Nash et al. | |

FOREIGN PATENT DOCUMENTS

| | | |
|---|---|---|
| WO | WO 99/14259 A1 | 4/1991 |
| WO | WO 96/02642 A1 | 2/1996 |
| WO | WO 96/34878 A1 | 11/1996 |
| WO | WO 97/13537 A1 | 4/1997 |
| WO | WO 97/26002 A1 | 7/1997 |
| WO | WO 97/37705 A1 | 10/1997 |
| WO | WO 99/34833 A1 | 7/1999 |
| WO | WO 99/34850 A1 | 7/1999 |
| WO | WO 00/06187 A2 | 2/2000 |
| WO | WO 00/06187 A3 | 5/2000 |
| WO | WO 02/064790 A2 | 8/2002 |
| WO | WO 02/064790 A3 | 5/2003 |
| WO | WO 03/106491 A2 | 12/2003 |
| WO | WO 2004/037754 A2 | 5/2004 |
| WO | WO 2004/041275 A2 | 5/2004 |
| WO | WO 2004/058804 A1 | 7/2004 |
| WO | WO 2004/037754 A3 | 10/2004 |
| WO | WO 03/106491 A3 | 12/2004 |
| WO | WO 2005/040202 A2 | 5/2005 |
| WO | WO 2005/044839 A2 | 5/2005 |
| WO | WO 2005/040202 A3 | 6/2005 |
| WO | WO 2005/044839 A3 | 7/2005 |
| WO | WO 2005/085457 A2 | 9/2005 |
| WO | WO 2005/090388 A1 | 9/2005 |
| WO | WO 2005/118620 A2 | 12/2005 |
| WO | WO 2005/118634 A2 | 12/2005 |
| WO | WO 2005/118634 A3 | 5/2006 |
| WO | WO 2006/103666 A2 | 10/2006 |
| WO | WO 2006/103666 A3 | 3/2007 |
| WO | WO 2007/141533 A2 | 12/2007 |
| WO | WO 2008/061192 A2 | 5/2008 |
| WO | WO 2008/095063 A1 | 8/2008 |
| WO | WO 2009/042237 A2 | 4/2009 |
| WO | WO 2010/034029 A1 | 3/2010 |

OTHER PUBLICATIONS

U.S. Appl. No. 13/250,344, filed Sep. 30, 2011, Arora et al.
U.S. Appl. No. 13/252,751, filed Oct. 4, 2011, Walensky et al.
U.S. Appl. No. 13/350,644, filed Jan. 13, 2012, Nash et al.
Ahn, et al. A convenient method for the efficient removal of ruthenium byproducts generated during olefin metathesis reactions. Organic Letters. 2001; 3(9):1411-1413.
Andrews et al. Forming Stable Helical Peptide Using Natural and Artificial Amino Acids. Tetrahedron. 1999;55:11711-11743.
Baell, J.B. Prospects for Targeting the Bcl-2 Family of Proteins to Develop Novel cytotoxic drugs. Biochem Pharmacol. Sep. 2002;64(5-6):851-63.
Belokon, Y.N. et al. Chiral Complexes of Ni(II), CU(II), and Cu(I) as Reagents, Catalysts and Receptors for Asymmetric Synthesis and Chiral Recognition of Amino Acids. Pure & Appl. Chem. 1992;64(12):1917-1924.
Belokon, Y.N. et al. Improved Procedures for the Synthesis of (S)-2-[N-(N-benzyl-prolyl) aminolbenzophenone (BPB) and Ni(II) complexes of Schiffs bases derived from BPB and Amino Acids. Tetrahedron: Asymmetry. 1998;9:4249-4252.
Bernal, et al. Reactivation of the p53 tumor suppressor pathway by a stapled p53 peptide. J Am Chem Soc. Mar. 7, 2007;129(9):2456-7.
Blackwell, et al. Highly Efficient Synthesis of Covalently Cross-Linked Peptide Helices by Ring-Closing Metathesis. Angewandte Chemie International Edition. 1998; 37(23):3281-3284.
Blackwell, et al. Ring-closing metathesis of olefinic peptides: design, synthesis, and structural characterization of macrocyclic helical peptides. J Org Chem. Aug. 10, 2001;66(16):5291-302.
Boguslavsky, et al. Effect of peptide conformation on membrane permeability. J Pept Res. Jun. 2003;61(6):287-97.
European search report and search opinion dated May 6, 2011 for Application No. 10195495.6.
European search report and search opinion dated May 9, 2011 for Application No. 10195490.7.
European search report dated Nov. 7, 2008 for Application No. 8016651.5.
European search report dated Aug. 22, 2008 for Application No. 4811198.3.
Gallou, et al. A practical method for the removal of ruthenium byproducts by supercritical fluid extraction. Organic Process Research and Development. 2006; 10:937-940.
Goodson, L.H. et al., Potential Growth Antagonists. I. Hydantoins and Disubstituted Glycines. Journal of Organic Chemistry. 1960;25:1920-1924.
Hiroshige. et al. Palladium-mediated macrocyclization on solid support and its applications to combinatorial synthesis. J Am Chem Soc. 1995; 117:11590-11591.
International search report dated May 18, 2005 for PCT Application No. US2004/38403.
Jackson et al. General approach to the synthesis of short alpha-helical peptides. JACS. 1991;113:9391-9392.
Kwon, et al. Quantitative comparison of the relative cell permeability of cyclic and linear peptides. Chem Biol. Jun. 2007;14(6):671-7.
Lee, et al. A novel BH3 ligand that selectively targets Mcl-1 reveals that apoptosis can proceed without Mcl-1 degradation. J Cell Biol. Jan. 28, 2008;180(2):341-355.
Mai et al. A proapoptotic peptide for the treatment of solid tumors Cancer Res. Nov. 1, 2001;61(21):7709-12.
Maynard, et al. Purification technique for the removal of ruthenium from olefin metathesis reaction products. Tetrahedron Letters. 1999; 40:4137-4140.
McNamara et al. Peptides constrained by an aliphatic linkage between two C(alpha) sites: design, synthesis, and unexpected conformational properties of an i,(i + 4)-linked peptide. J Org Chem. Jun. 29, 2001;66(13):4585-95.
Mustapa, et al. Synthesis of a cyclic peptide containing norlanthionine: effect of the thioether bridge on peptide conformation. J Org Chem. Oct. 17, 2003;68(21):8193-8.
Non-Final Office Action dated Dec. 5, 2008 from U.S. Appl. No. 10/981,873.
Office action dated Feb. 17, 2011 for U.S. Appl. No. 12/796,212.
Office action dated Apr. 18, 2011 for U.S. Appl. No. 12/182,673.
Office action dated Aug. 9, 2010 for U.S. Appl. No. 12/182,673.
Office action dated Oct. 18, 2011 for U.S. Appl. No. 12/796,212.
Office action dated Dec. 29, 2011 for U.S. Appl. No. 12/233,555.
Phelan et al. A general method for constraining short peptides to an alpha-helical conformation. JACS. 1997;119:455-460.
Ruffolo and Shore. BCL-2 Selectively Interacts with the BID-Induced Open Conformer of BAK, Inhibiting BAK Auto-Oligomerization. J. Biol. Chern. 2003;278(27):25039-25045.
Sanchez-Garcia, et al. Tumorigenic activity of the BCR-ABL oncogenes is mediated by BCL2. Proc Natl Acad Sci U S A. Jun. 6, 1995;92(12):5287-91.
Schafmeister et al. An all-hydrocarbon crosslinking system for enhancing the helicity and metabolic stability of peptides. J. Am Chem. Soc. 2000;122:5891-5892.
Schmiedeberg et al. Reversible backbone protection enables combinatorial solid-phase ring-closing metathesis reaction (RCM) in peptides. Org Lett. Jan. 10, 2002;4(1):59-62.

(56) References Cited

OTHER PUBLICATIONS

Stymiest, et al. Supporting information for: Solid Phase Synthesis of Dicarba Analogs of the Biologically Active Peptide Hormone Oxytocin Using Ring Closing Metathesis. Organic Letters. 2003. 1-8.
Stymiest, et al. Synthesis of biologically active dicarba analogues of the peptide hormone oxytocin using ring-closing metathesis. Org Lett. Jan. 9, 2003;5(1):47-9.
Titus, et al. Human K/natural killer cells targeted with hetero-cross-linked antibodies specifically lyse tumor cells in vitro and prevent tumor growth in vivo. J Immunol. Nov. 1, 1987;139(9):3153-8.
Tyndall et al. Macrocycles mimic the extended peptide conformation recognized by aspartic, serine, cysteine and metallo proteases. Curr Med Chem. Jul. 8, 2001(8):893-907.
Viallet, et al. Tallimustine is inactive in patients with previously treated small cell lung cancer. A phase II trial of the National Cancer Institute of Canada Clinical Trials Group. Lung Cancer. Nov. 1996;15(3):367-73.
Walensky et al. Activation of Apoptosis in Vivo by a Hydrocarbon-Stapled BH3 Helix. Science. Sep. 3, 2004;305(5689):1466-1470.
Wang et al. Cell permeable Bcl-2 binding peptides: a chemical approach to apoptosis induction in tumor cells. Cancer Res. Mar. 15, 2000;60(6):1498-502.
Wang et al. Enhanced metabolic stability and protein-binding properties of artificial alpha helices derived from a hydrogen-bond surrogate: application to Bcl-xL. Angew Chem Int Ed Engl. Oct. 14, 2005;44(40):6525-9.
Wei, et al. tBID, a membrane-targeted death ligand, oligomerizes BAK to release cytochrome c. Genes Dev. Aug. 15, 2000;14(16):2060-71.
Williams and Im. Asymmetric Synthesis of Nonsubstituted and α,α-Disubstituted α-Amino Acids via Disatereoselective Glycine Enolate Alkylations. JACS. 1991;113:9276-9286.
Yang et al. Synthesis and helical structure of lactam bridged BH3 peptides derived from pro-apoptotic Bcl-2 family proteins. Bioorg Med Chem Lett. Mar. 22, 2004;14(6):1403-6.
Yee, et al. Efficient large-scale synthesis of BILN 2061, a potent HCV protease inhibitor, by a convergent approach based on ring-closing metathesis. J Org Chem. Sep. 15, 2006;71(19):7133-45.
Zamzami et al. The thiol crosslinking agent diamide overcomes the apoptosis-inhibitory effect of Bcl-2 by enforcing mitochondrial permeability transition. Oncogene Feb. 26, 1998;16(8):1055-63.
Zhang, et al. Ruthenium-catalyzed cycloaddition of alkynes and organic azides. J Am Chem Soc. Nov. 23, 2005;127(46):15998-9.
U.S. Appl. No. 13/366,113, filed Feb. 3, 2012, Nash et al.
U.S. Appl. No. 13/370,057, filed Feb. 9, 2012, Nash et al.
U.S. Appl. No. 13/494,846, filed Jun. 12, 2012, Nash et al.
U.S. Appl. No. 13/680,905, filed Nov. 19, 2012, Verdine et al.
Austin et al., "A Template for Stabilization of a Peptide α-Helix: Synthesis and Evaluation of Conformational Effects by Circular Dichroism and NMR," J. Am. Chem. Soc. 119:6461-6472 (1997).
Bakhshi, et al. Cloning the chromosomal breakpoint of t(14;18) human lymphomas: clustering around JH on chromosome 14 and near a transcriptional unit on 18. Cell. Jul. 1985;41(3):899-906.
Balof, et al. Olefin metathesis catalysts bearing a pH-responsive NHC ligand: a feasible approach to catalyst separation from RCM products. Dalton Trans. Nov. 14, 2008;(42):5791-9. doi: 10.1039/b809793c. Epub Sep. 12, 2008.
Banerji et al., "Synthesis of Cyclic β-Turn Mimics from L-Pro-Phe/Phe-L-Pro Derived Di- and Tripeptides via Ring Closing Metathesis: The Role of Chirality of the Phe Residue During Cyclization," Tetrahedron Lett. 43:6473-6477 (2002).
Bang, et al. Total chemical synthesis of crambin. J Am Chem Soc. Feb. 11, 2004;126(5):1377-83.
Berendsen, H.J. A glimpse of the Holy Grail? Science. Oct. 23, 1998;282(5389):642-3.
Bossy-Wetzel, et al. Assays for cytochrome c release from mitochondria during apoptosis. Methods Enzymol. 2000;322:235-42.
Bossy-Wetzel, et al. Detection of apoptosis by annexin V labeling. Methods Enzymol. 2000;322:15-8.
Bradley, et al. Limits of cooperativity in a structurally modular protein: response of the Notch ankyrin domain to analogous alanine substitutions in each repeat. J Mol Biol. Nov. 22, 2002;324(2):373-86.
Brunel, et al. Synthesis of constrained helical peptides by thioether ligation: application to analogs of gp41. Chem Commun (Camb). May 28, 2005;(20):2552-4. Epub Mar. 11, 2005.
Cabezas & Satterthwait, "The Hydrogen Bond Mimic Approach: Solid-phase Synthesis of a Peptide Stabilized as an α-Helix with a Hydrazone Link," J. Am. Chem. Soc. 121:3862-3875 (1999).
Chakrabartty et al., "Helix Capping Propensities in Peptides Parallel Those in Proteins," Proc. Nat'l Acad. Sci. USA 90:11332-11336 (1993).
Chapman et al., "A Highly Stable Short α-Helix Constrained by a Main-chain Hydrogen-bond Surrogate," J. Am. Chem. Soc. 126:12252-12253 (2004).
Chapman, et al. Optimized synthesis of hydrogen-bond surrogate helices: surprising effects of microwave heating on the activity of Grubbs catalysts. Org Lett. Dec. 7, 2006;8(25):5825-8.
Chin & Schepartz, "Design and Evolution of a Miniature Bcl-2 Binding Protein," Angew. Chem. Int. Ed. 40(20):3806-3809 (2001).
Chin et al., "Circular Dichroism Spectra of Short, Fixed-nucleus Alanine Helices," Proc. Nat'l Acad. Sci. USA 99(24):15416-15421 (2002).
Chittenden, et al. A conserved domain in Bak, distinct from BH1 and BH2, mediates cell death and protein binding functions. EMBO J. Nov. 15, 1995;14(22):5589-96.
Cleary, et al. Nucleotide sequence of a t(14;18) chromosomal breakpoint in follicular lymphoma and demonstration of a breakpoint-cluster region near a transcriptionally active locus on chromosome 18. Proc Natl Acad Sci U S A. Nov. 1985; 82(21):7439-43.
Conrad, et al. Ruthenium-Catalyzed Ring-Closing Metathesis: Recent Advances, Limitations and Opportunities. Current Organic Chemistry. Jan. 2006; vol. 10, No. 2, 10(2):185-202(18).
Danial, et al. Cell death: critical control points. Cell. 2004; 116:204-219.
Degterev et al., "Identification of Small-molecule Inhibitors of Interaction between the BH3 Domain and Bcl-xL," Nature Cell Biol. 3:173-182 (2001).
Designing Custom Peptide. from SIGMA Genosys, pp. 1-2. Accessed Dec. 16, 2004.
Dimartino, et al. Solid-phase synthesis of hydrogen-bond surrogate-derived alpha-helices. Org Lett. Jun. 9, 2005;7(12):2389-92.
European office action dated Aug. 20, 2012 for EP Application No. 09730445.5.
Felix et al., "Synthesis, Biological Activity and Conformational Analysis of Cyclic GRF Analogs," Int. J. Pep. Protein Res. 32:441-454 (1988).
Fields, et al. Chapter 3 in Synthetic Peptides: A User's Guide. Grant W.H. Freeman & Co. New York, NY. 1992. p. 77.
Fieser, et al. Fieser and Fieser's Reagents for Organic Synthesis. John Wiley and Sons. 1994.
Fischer, et al. Apoptosis-based therapies and drug targets. Cell Death and Differentiation. 2005; 12:942-961.
Fulda, et al. Extrinsic versus intrinsic apoptosis pathways in anticancer chemotherapy. Oncogene. Aug. 7, 2006;25(34):4798-811.
Furstner, et al. Alkyne metathesis: development of a novel molybdenum-based catalyst system and its application to the total synthesis of epothilone A and C. Chemistry. Dec. 17, 2001;7(24):5299-317.
Furstner, et al. Mo[N(t-Bu)(AR)]3 Complexes as catalyst precursors: In situ activation and application to metathesis reactions of alkynes and diynes. J Am chem Soc. 1999; 121:9453-54.
Galande, et al. An effective method of on-resin disulfide bond formation in peptides. J. Comb. Chem. Mar.-Apr. 2005;7(2):174-177.
Gallivan, et al. A neutral, water-soluble olefin metathesis catalyst based on an N-heterocyclic carbene ligand. Tetrahedron Letters. 2005; 46:2577-80.
Galluzzi, et al. Guidelines for the use and interpretation of assays for monitoring cell death in higher eukaryotes. Cell Death Differ. Aug. 2009;16(8):1093-107. Epub Apr. 17, 2009.

(56) References Cited

OTHER PUBLICATIONS

Ghadiri & Choi, "Secondary Structure Nucleation in Peptides. Transition Metal Ion Stabilized α-Helices," J. Am. Chem. Soc. 112:1630-1632 (1990).
Gras-Masse, et al. Influence of helical organization on immunogenicity and antigenicity of synthetic peptides. Mol Immunol. Jul. 1988;25(7):673-8.
Greene, et al. Protective Groups in Organic Synthesis, 2nd Ed. John Wiley and Sons. 1991.
Hoveyda et al., "Ru Complexes Bearing Bidentate Carbenes: From Innocent Curiosity to Uniquely Effective Catalysts for Olefin Metathesis," Org. Biomolec. Chem. 2:8-23 (2004).
International search report dated Nov. 30, 2009 for PCT Application No. US2009/02225.
Karle, et al. Structural charateristics of alpha-helical peptide molecules containing Aib residues. Biochemistry. Jul. 24, 1990;29(29):6747-56.
Karle. Flexibility in peptide molecules and restraints imposed by hydrogen bonds, the Aib residue, and core inserts. Biopolymers. 1996;40(1):157-80.
Kelso et al., "A Cyclic Metallopeptide Induces α Helicity in Short Peptide Fragments of Thermolysin," Angew. Chem. Int. Ed. 42(4):421-424 (2003).
Kelso et al., "α-Turn Mimetics: Short Peptide α-Helices Composed of Cyclic Metallopentapeptide Modules," J. Am. Chem. Soc. 126:4828-4842 (2004).
Kemp et al., "Studies of N-Terminal Templates for α-Helix Formation. Synthesis and Conformational Analysis of (2S,5S,8S,11S)-1-Acetyl-1,4-diaza-3-keto-5-carboxy-10-thiatricyclo[2.8.1.04,8]-tridecane (Ac-Hell-OH)," J. Org. Chem. 56:6672-6682 (1991).
KENT. Advanced Biology. Oxford University Press. 2000.
Kilby et al., "Potent Suppression of HIV-1 Replication in Humans by T-20, a Peptide Inhibitor of gp41-Mediated Virus Entry," Nat. Med. 4(11):1302-1307 (1998).
Kritzer et al., "Helical β-Peptide Inhibitors of the p53-hDM2 Interaction," J. Am. Chem. Soc. 126:9468-9469 (2004).
Kutzki et al., "Development of a Potent Bcl-xL Antagonist Based on α-Helix Mimicry," J. Am. Chem. Soc. 124:11838-11839 (2002).
Larock. Comprehensive Organic Transformations. VCH Publishers. 1989.
Leduc, et al. Helix-stabilized cyclic peptides as selective inhibitors of steroid receptor-coactivator interactions. Proc Natl Acad Sci U S A. Sep. 30, 2003;100(20):11273-8.
Li, et al. Application of Olefin Metathesis in Organic Synthesis. Speciality Petrochemicals. 2007; 79-82 (in Chinese with English abstract).
Liskamp, et al. Conformationally restricted amino acids and dipeptides, (non)peptidomimetics and secondary structure mimetics. Recl Travl Chim Pays-Bas. 1994; 113:1-19.
Litowski & Hodges, "Designing Heterodimeric Two-stranded α-Helical Coiled-coils: Effects of Hydrophobicity and α-Helical Propensity on Protein Folding, Stability, and Specificity," J. Biol. Chem. 277(40):37272-37279 (2002).
Luo, et al. Mechanism of helix induction by trifluoroethanol: a framework for extrapolating the helix-forming properties of peptides from trifluoroethanol/water mixtures back to water. Biochemistry. Jul. 8, 1997;36(27):8413-21.
Lyu & Wemmer, "Capping Interactions in Isolated α Helices: Position-dependent Substitution Effects and Structure of a Serine-capped Peptide Helix," Biochemistry 32:421-425 (1993).
Lyu et al, "α-Helix Stabilization by Natural and Unnatural Amino Acids with Alkyl Side Chains," Proc. Nat'l Acad. Sci. USA 88:5317-5320 (1991).
McGahon, et al. The end of the (cell) line: methods for the study of apoptosis in vitro. Methods Cell Biol. 1995;46:153-85.
Mosberg, et al. Dithioeter-containing cyclic peptides. J. Am. Chem. Soc. 1985;107(10):2986-2987.
Muchmore, et al. X-ray and NMR structure of human Bcl-xL, an inhibitor of programmed cell death. Nature. May 23, 1996;381(6580):335-41.
Nelson & Kallenbach, "Persistence of the α-Helix Stop Signal in the S-Peptide in Trifluoroethanol Solutions," Biochemistry 28:5256-5261 (1989).
Ngo, et al. Computational complexity, protein structure predictioni, and the levinthal paradox. In the Protein Folding Problem and Tertiary Structure Prediction. K. Merc Jr, et al. Eds. 1994; 491-495.
O'Neil & DeGrado, "A Thermodynamic Scale for the Helix-forming Tendencies of the Commonly Occurring Amino Acids," Science 250:646-651(1990).
Office action dated Jan. 26, 2009 for U.S. Appl. No. 11/148,976.
Office Action dated Jan. 30, 2008 for U.S. Appl. No. 10/981,873.
Office action dated Feb. 9, 2012 for U.S. Appl. No. 12/420,816.
Office action dated Mar. 22, 2013 for U.S. Appl. No. 12/233,555.
Office action dated Jun. 28, 2012 for U.S. Appl. No. 12/233,555.
Office action dated Jul. 15, 2013 for U.S. Appl. No. 13/570,146.
Office action dated Sep. 23, 2013 for U.S. Appl. No. 13/680,905.
Office action dated Nov. 5, 2002 for U.S. Appl. No. 09/574,086.
Office action dated Nov. 25, 2009 for U.S. Appl. No. 11/148,976.
Office action dated Dec. 19, 2012 for U.S. Appl. No. 13/350,644.
Or et al. Cysteine alkylation in unprotected peptides: synthesis of a carbavasopressin analogue by intramolecular cystein alkylation. J. Org. Chem. Apr. 1991;56(9):3146-3149.
Ösapay & Taylor, "Multicyclic Polypeptide Model Compounds. 2. Synthesis and Conformational Properties of a Highly α-Helical Uncosapeptide Constrained by Three Side-chain to Side-chain Lactam Bridges," J. Am. Chem. Soc. 114:6966-6973 (1992).
Paquette. Encyclopedia of Reagents for Organic Synthesis. John Wiley and Sons. 1995.
Punna, et al. Head-to-tail peptide cyclodimerization by copper-catalyzed azide-alkyne cycloaddition. Angew Chem Int Ed Engl. Apr. 8, 2005;44(15):2215-20.
Roberts, et al. Efficient synthesis of thioether-based cyclic peptide libraries. Tetrahedon Letters. 1998; 39: 8357-8360.
Roberts, et al. Examination of methodology for the synthesis of cyclic thioether peptide libraries derived from linear tripeptides. J Pept Sci. Dec. 2007;13(12):811-21.
Ruan et al., "Metal Ion Enhanced Helicity in Synthetic Peptides Containing Unnatural, Metal-ligating Residues," J. Am. Chem. Soc. 112:9403-9404 (1990).
Rudinger, J. Characteristics of the amino acids as components of a peptide hormone sequence. In Peptide Hormones. J. A. Parsons, ed. University Park Press. Jun. 1976; pp. 1-7.
Schinzel, et al. The phosphate recognition site of Escherichia coli maltodextrin phosphorylase. FEBS Lett. Jul. 29, 1991;286(1-2):125-8.
Scorrano, et al. A distinct pathway remodels mitochondrial cristae and mobilizes cytochrome c during apoptosis. Dev Cell. Jan. 2002;2(1):55-67.
Shepherd et al., "Single Turn Peptide Alpha Helices with Exceptional Stability in Water," J. Am. Chem. Soc. 127:2974-2983 (2005).
Sia et al., "Short Constrained Peptides that Inhibit HIV-1 Entry," Proc. Nat'l Acad. Sci. USA 99(23):14664-14669 (2002).
Spierings, et al. Connected to death: the (unexpurgated) mitochondrial pathway of apoptosis. Science. 2005; 310:66-67.
Spouge, et al. Strong conformational propensities enhance t cell antigenicity. J Immunol Jan. 1, 1987;138(1):204-12.
Stewart, et al. Cell-penetrating peptides as delivery vehicles for biology and medicine. Org Biomol Chem. Jul. 7, 2008;6(13):2242-55. doi: 10.1039/b719950c. Epub Apr. 15, 2008.
Suzuki, et al. Structure of Bax: coregulation of dimer formation and intracellular localization. Cell. Nov. 10, 2000;103(4):645-54.
Szewczuk, et al. Synthesis and biological activity of new conformationally restricted analogues of pepstatin. Int. J. Pept. Protein Res. Sep.-Oct. 1992;40(3-4):233-42.
Tanaka, M. Design and synthesis of non-proteinogenic amino acids and secondary structures of their peptides. Yakugaku Zasshi. Oct. 2006;126(10):931-44.
Taylor. The synthesis and study of side-chain lactam-bridged peptides. Biopolymers. 2002;66(1):49-75.
Trnka & Grubbs, "The Development of L2X2Ru=CHR Olefin Metathesis Catalysts: An Organometallic Success Story," Acc. Chem. Res. 34:18-29 (2001).

(56) References Cited

OTHER PUBLICATIONS

Tugyi, et al. The effect of cyclization on the enzymatic degradation of herpes simplex virus glycoprotein D derived epitope peptide. J Pept Sci. Oct. 2005;11(10):642-9.
Vaickus, et al. Immune markers in hematologic malignancies. Crit Rev Oncol Hematol. Dec. 1991;11(4):267-97.
Voet, et al. Biochemistry, Second Edition. John Wiley & Sons, Inc. 1995; pp. 235-241.
Wang, et al. BID: a novel BH3 domain-only death agonist. Genes Dev. Nov. 15, 1996;10(22):2859-69.
Wang, et al. Evaluation of biologically relevant short alpha-helices stabilized by a main-chain hydrogen-bond surrogate. J Am Chem Soc. Jul. 19, 2006;128(28):9248-56.
Wang, et al. Nucleation and stability of hydrogen-bond surrogate-based alpha-helices. Org Biomol Chem. Nov. 21, 2006;4(22):4074-81.
Wild et al., "Peptides Corresponding to a Predictive α-Helical Domain of Human Immunodeficiency Virus Type 1 gp41 are Potent Inhibitors of Virus Infection," Proc. Nat'l Acad. Sci. USA 91:9770-9774 (1994).
Yang, et al. Calculation of protein conformation from circular dichroism. Methods Enzymol. 1986;130:208-69.
Zhang, et al. 310 Helix versus alpha-helix: a molecular dynamics study of conformational preferences of Aib and Alanine. J. American Cancer Society. Dec. 1994; 116(26):11915-11921.
Office action dated May 29, 2013 for U.S. Appl. No. 13/350,644.
Clavier, et al. Ring-closing metathesis in biphasic BMI•$PF_6$ ionic liquid/toluene medium: a powerful recyclable and environmentally friendly process. Chem Commun (Camb). Oct. 21, 2004; (20):2282-3. Epub Aug. 25, 2004.
Dyson, et al. Applications of ionic liquids in synthesis and catalysis. Interface-Electrochemical Society. 2007; 16(1), 50-53.
European Medicines Agency (Pre-authorization Evaluation of Medicines for Human Use, London, Jan. 2007, p. 1-32).
Lenntech BV Water Treatment Solutions. http://www.lenntech.com/periodic/elements/ru.htm.Copyright © 1998-2014.
Office action dated Feb. 6, 2014 for U.S. Appl. No. 13/350,644.
Office action dated Feb. 6, 2014 for U.S. Appl. No. 13/680,905.
European Medicines Agency, Guideline on the specification limits for residues of metal catalysts or metal regents. Feb. 2008; pp, 1-34.
Nobuo Izimiya et al. Pepuchido Gosei no Kiso to Jikken (Fundamental of peptide synthesis and experiments, Jan. 20, 1985, p. 271.
Berezowska, et al. Cyclic dermorphin tetrapeptide analogues obtained via ring-closing metathesis. Acta Biochim Pol. 2006;53(1):73-6. Epub Feb. 23, 2006.
Carlson et al., Specificity landscapes of DNA binding molecules elucidate biological function. Proc Natl Acad Sci USA. Mar. 9, 2010;107(10):4544-9. doi: 10.1073/pnas.0914023107. Epub Feb. 22, 2010.
Chen, et al. Determination of the helix and beta form of proteins in aqueous solution by circular dichroism. Biochemistry. Jul. 30, 1974;13(16):3350-9.
Colaluca et al., NUMB controls p53 tumour suppressor activity. Nature. Jan. 3, 2008;451(7174):76-80. doi: 10.1038/nature06412.
Darnell, Transcription factors as targets for cancer therapy. Nat Rev Cancer. Oct. 2002;2(10):740-9.
Dennis, et al. Albumin binding as a general strategy for improving the pharmacokinetics of proteins. J Biol Chem. Sep. 20, 2002;277(38):35035-43. Epub Jul. 15, 2002.
European search opinion dated Nov. 19, 2014 for EP 09828398.9.
Extended European Search Report (Replacement Copy) for EP 12159110.1, mailed Sep. 27, 2012 (H0824.70040EP01).
Extended European Search Report for EP 12159110.1, mailed Jul. 20, 2012 (H0824.70040EP01).
Gentle, et al. Direct production of proteins with N-terminal cysteine for site-specific conjugation. Bioconjug Chem. May.-Jun. 2004;15(3):658-63.
Kim et al., Introduction of all-hydrocarbon i,i+3 staples into alpha-helices via ring-closing olefin metathesis. Org Lett. Jul. 2, 2010;12(13):3046-9. doi: 10.1021/o11010449.
Kim et al., Synthesis of all-hydrocarbon stapled a-helical peptides by ring-closing olefin metathesis. Nat Protoc. Jun. 2011;6(6):761-71. doi: 10.1038/nprot.2011.324. Epub May 12, 2011.
Li, et al. A versatile platform to analyze low-affinity and transient protein-protein interactions in living cells in real time. Cell Rep. Dec. 11, 2014;9(5):1946-58. doi: 10.1016/j.celrep.2014.10.058. Epub Nov. 20, 2014.
Luscher, et al. The basic region/helix-loop-helix/leucine zipper domain of Myc proto-oncoproteins: function and regulation. Oncogene. May 13, 1999;18(19):2955-66.
Muppidi et al., Conjugation of spermine enhances cellular uptake of the stapled peptide-based inhibitors of p53-Mdm2 interaction. Bioorg Med Chem Lett. Dec. 15, 2011;21(24):7412-5. doi: 10.1016/j.bmcl.2011.10.009. Epub Oct. 12, 2011.
Robert. A hierarchical "nesting" approach to describe the stability of alpha helices with side-chain interactions. Biopolymers. 1990;30(3-4):335-47.
Sali, et al. Stabilization of protein structure by interaction of alpha-helix dipole with a charged side chain. Nature. Oct. 20, 1988;335(6192):740-3.
Toniolo. Conformationally restricted peptides through short-range cyclizations. Int J Pept Protein Res. Apr. 1990;35(4):287-300.
Verdine et al., Stapled peptides for intracellular drug targets. Methods Enzymol. 2012;503:3-33. doi: 10.1016/B978-0-12-396962-0.00001-X.
International Search Report and Written Opinion for PCT/US2008/052580, mailed May 16, 2008.
Miller et al. Application of Ring-Closing Metathesis to the Synthesis of Rigidified Amino Acids and Peptides. J Am Chem Soc. 1996;118(40):9606-9614.
Miller et al. Synthesis of Conformationally Restricted Amino Acids and Peptides Employing Olefin Metathesis. J Am Chem Soc. 1995;117(21):5855-5856.

* cited by examiner

METHODS FOR PREPARING PURIFIED POLYPEPTIDE COMPOSITIONS

CROSS-REFERENCE

This application claims the benefit of U.S. Provisional Application No. 61/099,099, filed Sep. 22, 2008, which application is incorporated herein by reference.

SEQUENCE LISTING

The instant application contains a Sequence Listing which has been submitted in ASCII format via EFS-Web and is hereby incorporated by reference in its entirety. Said ASCII copy, created on Mar. 6, 2013 is named 35224-723.201 SL.txt and is 44-762,490 bytes in size.

BACKGROUND OF THE INVENTION

Peptides are important in biological processes. For example, peptides can serve as hormones, enzyme inhibitors, substrates, neurotransmitters, neuromediators, as well as many other functions. Peptides can bind to receptors or enzymes and thus influence intercellular communication and control vital cell functions such as metabolism, immune defense and reproduction (Babine et al., Chem. Rev. 1997, 97, 1359). Hence, there is an interest for using peptides in medicinal chemistry as therapeutic agents and in pharmaceutical applications.

The utility of unmodified peptides as therapeutics and pharmaceuticals have been limited by several factors. These limitations include poor metabolic stability such as susceptibility to peptidase degradation, poor cell penetrability, and lack of binding specificity due to conformational flexibility. Attempts to improve these limiting properties have been described and include generation of cyclic peptides and peptidomimetics by a variety of methods, including disulfide bond formation, amide bond formation, and carbon-carbon bond formation (Jackson et al. (1991), *J. Am. Chem. Soc.* 113:9391-9392; Phelan et al. (1997), *J. Am. Chem. Soc.* 119: 455-460; Taylor (2002), *Biopolymers* 66: 49-75; Brunel et al. (2005), *Chem. Commun.* (20):2552-2554; Hiroshige et al. (1995), *J. Chem. Soc.* 117: 11590-11591; Blackwell et al. (1998), *Angew. Chem. Int. Ed.* 37:3281-3284; Schafineister et al. (2000), *J. Am. Chem. Soc.* 122:5891-5892). These approaches are still limited by factors including poor metabolic stability (disulfide and amide bonds), poor cell penetrability (disulfide and amide bonds), and the use of potentially toxic metals (for carbon-carbon bond formation). In particular, the presence of toxic metal impurities may pose a significant challenge to the clinical use of polypeptide drugs which are manufactured via chemical reactions that require such metals, for example in the form of catalysts. Therefore, there is a need for methods of purifying peptidomimetic compounds and for the pure compositions generated by such methods.

SUMMARY OF THE INVENTION

The present invention addresses these and other needs. In one aspect, the invention provides a method for preparing a purified peptidomimetic macrocycle composition. In one embodiment, the method comprises contacting a peptidomimetic precursor and purifying the crude peptidomimetic macrocycle to result in a purified peptidomimetic macrocycle composition. In such embodiment, the peptidomimetic precursor may comprise at least two moieties capable of undergoing a metathesis reaction with a metathesis catalyst to produce a crude peptidomimetic macrocycle.

The peptidomimetic macrocycle composition purified according the method disclosed herein may include a metal. In one embodiment, the metal of the composition comprises less than about 75, 20, 10, 5 or 1 ppm by weight. In another embodiment, the purified peptidomimetic macrocycle composition comprises a metal concentration that can be safely administered to a subject, such as a human subject.

The present invention also provides a composition comprising a peptidomimetic macrocycle comprising a cross-linker connecting a first amino acid to a second amino acid and a metal at a concentration between about 0.5 ppm and about 1, 5, 10, 20, or 75 ppm by weight. In one embodiment, the composition comprises a peptidomimetic macrocycle comprising a cross-linker connecting a first amino acid and a second amino acid, wherein at least one of said amino acids is an α,α-disubstituted amino acid, and further wherein a metal concentration of said composition is less than about 1, 5, 10, 20, or 75 ppm by weight. In a related embodiment, the composition comprises a cross-linker wherein the first amino acid is α,α-disubstituted. In another related embodiment, the composition comprises a cross-linker wherein the second amino acid is α,α-disubstituted.

In some embodiments, the peptidomimetic macrocycle comprises a helix, an alpha-helix, alpha-helical domain of a BCL-2 family member, or a BH3 domain. The peptidomimetic macrocycle may be homologous to a peptide sequence in Table 1, 2, 3, or 4. In one embodiment, the homology between the peptidomimetic macrocycle and the sequence in Table 1 may be at least 60% or at least 80%.

The peptidomimetic macrocycle preferably includes a crosslinker connecting a first amino acid to a second amino acid. In one embodiment, the first amino acid and the second amino acid are separated by three amino acids. In another embodiment, the first amino acid and the second amino acid are separated by six amino acids.

In one embodiment, the crosslinker comprises between 6 and 14 consecutive bonds. In another embodiment, the crosslinker comprises between 8 and 16 consecutive bonds. In another embodiment, the crosslinker comprises between 8 and 12 consecutive bonds. In another embodiment, the crosslinker comprises between 10 and 13 consecutive bonds.

The peptidomimetic macrocycle preferably comprises a helical structure. The helical structure may comprise one or more turns of an alpha-helix. For example, the crosslinker may include an alpha-helix comprising 1, 2 or more turns. In one embodiment, the crosslinker spans from 1 turn to 5 turns of an alpha-helix. In another embodiment, the crosslinker comprises a length of about 5 Å to about 9 Å per turn of the alpha-helix.

In one aspect of the crosslinker, the alpha position of the first amino acid or of the second amino acid can be substituted. In one embodiment, the alpha position of the first amino acid is additionally substituted. In another embodiment, the alpha position of the second amino acid is additionally substituted.

In one embodiment, the peptidomimetic macrocycle comprises a ring of about 18 atoms to about 26 atoms. In another embodiment, the peptidomimetic macrocycle comprises a ring of about 29 atoms to about 37 atoms.

The peptidomimetic macrocycle may carry a net positive charge at 5% below or above the physiological pH of a subject treated with the peptidomimetic macrocycle. In one embodiment, the peptidomimetic macrocycle may carry a net positive charge at about pH 7.4.

The peptidomimetic macrocycle may comprise moieties comprising one or more of a halogen, alkyl group, a fluorescent moiety, affinity label, targeting moiety, or a radioisotope.

The peptidomimetic macrocycle may be useful as a therapeutic agent. In one embodiment, the peptidomimetic macrocycle of the present invention is provided as a therapeutic agent for the treatment of a cancer. In another embodiment, the peptidomimetic macrocycle of the present invention is provided as a therapeutic agent under evaluation in a clinical trial.

The peptidomimetic macrocycle composition of the present invention may contain a metal. The concentration, and the type of the metal employed in the synthesis of peptidomimetic macrocycle composition may vary. Non-limiting examples of metal concentrations (by weight) employed in the present invention include less than about 1 ppm, less than about 2 ppm, less than about 2.5 ppm, about 0.5 ppm, about 1 ppm, about 10 ppm, about 1 to about 5, 10, 20, 75 ppm, or about 0.5 to about 5, 10, 20, or 75 ppm.

In one aspect, the metal of the peptidomimetic macrocycle is ruthenium or osmium. In one embodiment, the composition comprises a total concentration of ruthenium of less about that 1, 5, 10, 20, or 75 ppm by weight. In another embodiment, the composition comprises a total concentration of ruthenium of about 0.5 ppm to about 5, 10, 20, or 75 ppm by weight.

The invention employs one or more metathesis reaction to produce peptidomimetic macrocycle. In one embodiment, the metathesis catalyst comprises a ruthenium or osmium catalyst. In a related embodiment, the metathesis catalyst comprises one or more substituents which are iodine, bromine, chlorine, phenyl, carbene, cyclohexyl, phosphine, tricyclohexylphosphine, imidazole, or benzylidene. In one aspect, the metathesis catalyst is bound to a solid support.

The peptidomimetic macrocycle composition of the present invention may contain excipients. In one embodiment, the peptidomimetic macrocycle additionally comprises a pharmaceutically acceptable carrier. The peptidomimetic macrocycle composition can exist in various forms in the presence or absent of a solvent, such as powder, salt, liquid, or lyophilized. In one embodiment, the peptidomimetic macrocycle composition comprises a pharmaceutically acceptable salt of the peptidomimetic macrocycle. The pharmaceutically acceptable salt of the peptidomimetic may comprise, for example, a hydrochloric acid or an acetate salt.

INCORPORATION BY REFERENCE

All publications, patents, and patent applications mentioned in this specification are herein incorporated by reference to the same extent as if each individual publication, patent, or patent application was specifically and individually indicated to be incorporated by reference.

DETAILED DESCRIPTION OF THE INVENTION

Definitions

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker (or "crosslinker") which forms a macrocycle between a first naturally-occurring or non-naturally-occurring amino acid residue (or analog) and a second naturally-occurring or non-naturally-occurring amino acid residue (or analog) within the same molecule. Peptidomimetic macrocycle include embodiments where the macrocycle-forming linker connects the a carbon of the first amino acid residue (or analog) to the a carbon of the second amino acid residue (or analog). The peptidomimetic macrocycles optionally include one or more non-peptide bonds between one or more amino acid residues and/or amino acid analog residues, and optionally include one or more non-naturally-occurring amino acid residues or amino acid analog residues in addition to any which form the macrocycle.

As used herein, the term "stability" refers to the maintenance of a defined secondary structure in solution by a peptidomimetic macrocycle of the invention as measured by circular dichroism, NMR or another biophysical measure, or resistance to proteolytic degradation in vitro or in vivo. Non-limiting examples of secondary structures contemplated in this invention are α-helices, β-turns, and β-pleated sheets.

As used herein, the term "helical stability" refers to the maintenance of a helical structure by a peptidomimetic macrocycle of the invention as measured by circular dichroism or NMR. For example, in some embodiments, the peptidomimetic macrocycles of the invention exhibit at least a 1.25, 1.5, 1.75 or 2-fold increase in α-helicity as determined by circular dichroism compared to a corresponding macrocycle lacking the R— substituent.

The term "α-amino acid" or simply "amino acid" refers to a molecule containing both an amino group and a carboxyl group bound to a carbon which is designated the α-carbon. Suitable amino acids include, without limitation, both the D- and L-isomers of the naturally-occurring amino acids, as well as non-naturally occurring amino acids prepared by organic synthesis or other metabolic routes. Unless the context specifically indicates otherwise, the term amino acid, as used herein, is intended to include amino acid analogs.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The term "amino acid analog" or "non-natural amino acid" refers to a molecule which is structurally similar to an amino acid and which can be substituted for an amino acid in the formation of a peptidomimetic macrocycle. Amino acid analogs include, without limitation, compounds which are structurally identical to an amino acid, as defined herein, except for the inclusion of one or more additional methylene groups between the amino and carboxyl group (e.g., α-amino β-carboxy acids), or for the substitution of the amino or carboxy group by a similarly reactive group (e.g., substitution of the primary amine with a secondary or tertiary amine, or substitution or the carboxy group with an ester).

A "non-essential" amino acid residue is a residue that can be altered from the wild-type sequence of a polypeptide (e.g., a BH3 domain or the p53 MDM2 binding domain) without abolishing or substantially altering its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a BH3 polypeptide, for example, is preferably replaced with another amino acid residue from the same side chain family. Other examples of acceptable substitutions are substitutions based on isosteric considerations (e.g. norleucine for methionine) or other properties (e.g. 2-thienylalanine for phenylalanine).

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⫽" when used as part of a molecular structure refers to a single bond or a trans or cis double bond.

The term "amino acid side chain" refers to a moiety attached to the α-carbon in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,α di-substituted amino acid).

The term "α,α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "macrocyclization reagent" or "macrocycle-forming reagent" as used herein refers to any reagent which may be used to prepare a peptidomimetic macrocycle of the invention by mediating the reaction between two reactive groups. The reactive groups may be, for example terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. Additional catalysts are disclosed in Grubbs et al., "Ring Closing Metathesis and Related Processes in Organic Synthesis" Acc. Chem. Res. 1995, 28, 446-452, U.S. Pat. Nos. 5,811,515, 6,111,121, and 6,921,735. In yet other cases, the reactive groups are thiol groups. In such embodiments, the macrocyclization reagent is, for example, a linker functionalized with two thiol-reactive groups such as halogen groups.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkyl" or the term "aralkyl" refers to alkyl substituted with an aryl. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH2-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl, "Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH3, and —CH$_2$—CH$_2$—NH—C(O)—CH=CH$_2$.

"Alkanol" refers to a $C_1$-$C_5$ alkyl group, as defined above, wherein one of the $C_1$-$C_5$ alkyl group's hydrogen atoms has been replaced with a hydroxyl group. Representative examples of an alkanol group include, but are not limited to, —$CH_2OH$, —$CH_2CH_2OH$, —$CH_2CH_2CH_2OH$, —$CH_2CH_2CH_2CH_2OH$, —$CH_2CH_2CH_2CH_2CH_2OH$, —$CH_2CH(OH)CH_3$, —$CH_2CH(OH)CH_2CH_3$, —$CH(OH)CH_3$ and —$C(CH_3)_2CH_2OH$.

"Alkylcarboxy" refers to a $C_1$-$C_5$ alkyl group, as defined above, wherein one of the $C_1$-$C_5$ alkyl group's hydrogen atoms has been replaced with a —COOH group. Representative examples of an alkylcarboxy group include, but are not limited to, —$CH_2COOH$, —$CH_2CH_2COOH$, —$CH_2CH_2CH_2COOH$, —$CH_2CH_2CH_2CH_2COOH$, —$CH_2CH(COOH)CH_3$, —$CH_2CH_2CH_2CH_2CH_2COOH$, —$CH_2CH(COOH)CH_2CH_3$, —$CH(COOH)CH_2CH_3$ and —$C(CH_3)_2CH_2COOH$.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds of this invention contain one or more asymmetric centers and thus occur as racemates and racemic mixtures, single enantiomers, individual diastereomers and diastereomeric mixtures. All such isomeric forms of these compounds are included in the present invention unless expressly provided otherwise. In some embodiments, the compounds of this invention are also represented in multiple tautomeric forms, in such instances, the invention includes all tautomeric forms of the compounds described herein (e.g., if alkylation of a ring system results in alkylation at multiple sites, the invention includes all such reaction products). All such isomeric forms of such compounds are included in the present invention unless expressly provided otherwise. All crystal forms of the compounds described herein are included in the present invention unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the invention may be practiced with the variable equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The term "on average" represents the mean value derived from performing at least three independent replicates for each data point.

The term "biological activity" encompasses structural and functional properties of a macrocycle of the invention. Biological activity is, for example, structural stability, alpha-helicity, affinity for a target, resistance to proteolytic degradation, cell penetrability, intracellular stability, in vivo stability, or any combination thereof.

The details of one or more particular embodiments of the invention are set forth in the accompanying drawings and the description below. Other features, objects, and advantages of the invention will be apparent from the description and drawings, and from the claims.

Peptidomimetic Macrocycles of the Invention

In some embodiments, a peptidomimetic macrocycle of the invention has the Formula (I):

Formula (I)

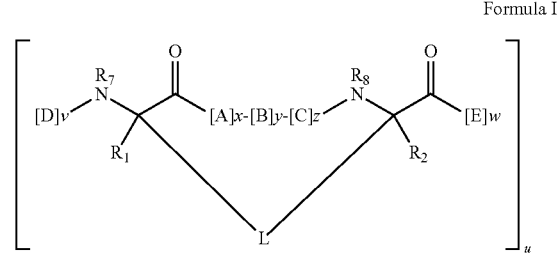

(SEQ ID NO: 101)

wherein:

each A, C, D, and E is independently a natural or non-natural amino acid;

B is a natural or non-natural amino acid, amino acid analog,

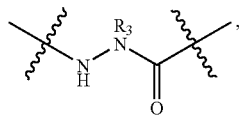

[—NH-$L_3$-CO—], [—NH-$L_3$-$SO_2$—], or [—NH-$L_3$-];

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

L is a macrocycle-forming linker of the formula -$L_1$-$L_2$-;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —$N(R_6)_2$, —$SR_6$, —$SOR_E$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v and w are independently integers from 1-1000;

u, x, y and z are independently integers from 0-10; and n is an integer from 1-5.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments of the invention, x+y+z is at least 3. In other embodiments of the invention, x+y+z is 1, 2, 3, 4, 5, 6, 7, 8, 9 or 10. Each occurrence of A, B, C, D or E in a macrocycle or macrocycle precursor of the invention is independently selected. For example, a sequence represented by the formula [A]$_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound of the invention may encompass peptidomimetic macrocycles which are the same or different. For example, a compound of the invention may comprise peptidomimetic macrocycles comprising different linker lengths or chemical compositions.

In some embodiments, the peptidomimetic macrocycle of the invention comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

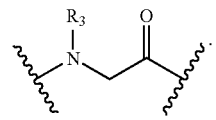

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In one embodiment, the peptidomimetic macrocycle of Formula (I) is:

(SEQ ID NO: 102)

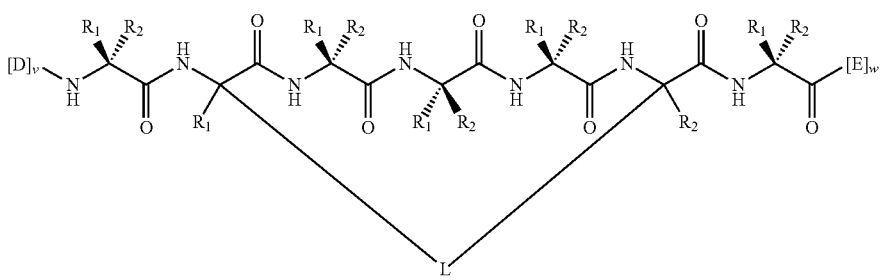

wherein each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle of Formula (I) is:

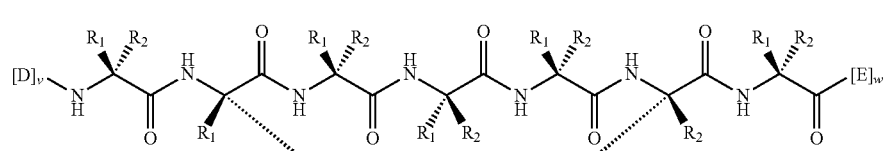
(SEQ ID NO: 103)
or
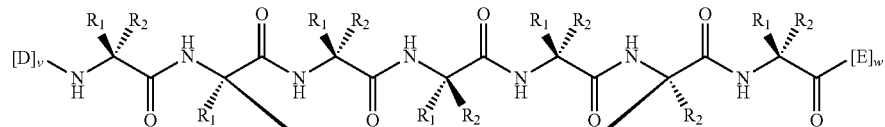
(SEQ ID NO: 104)
In other embodiments, the peptidomimetic macrocycle of Formula (I) is a compound of any of the formulas shown below:
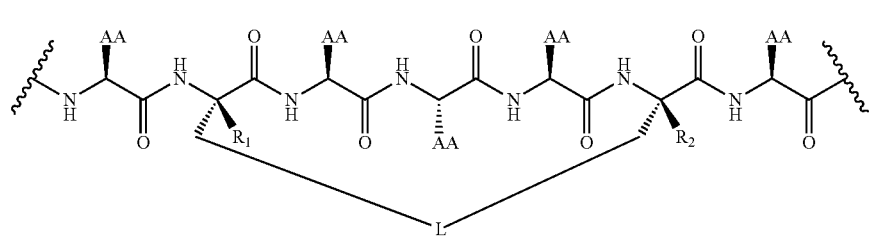
(SEQ ID NO: 105)
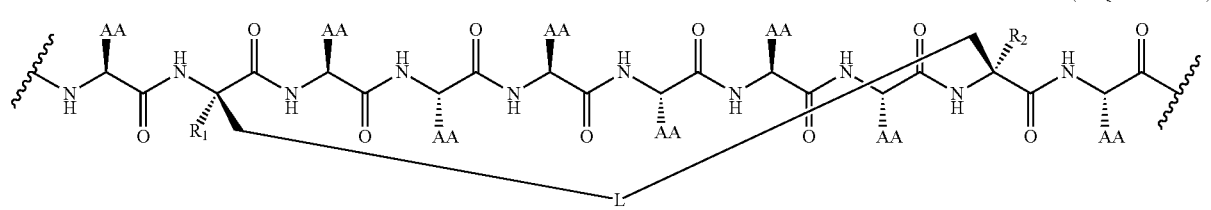
(SEQ ID NO: 106)
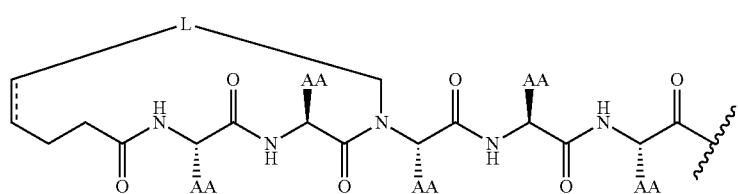
(SEQ ID NO: 107)
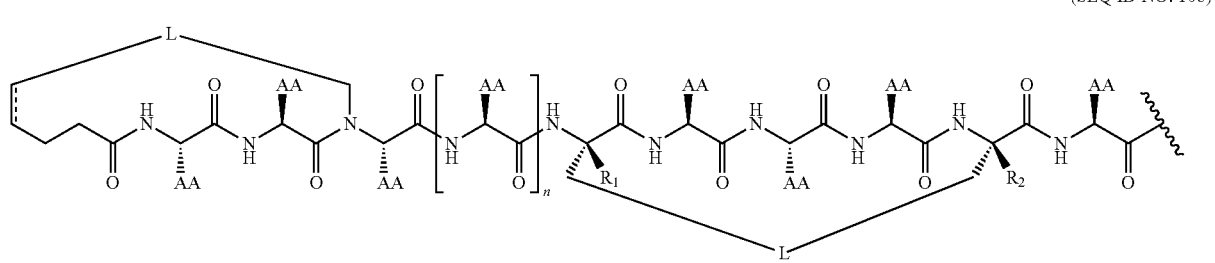
(SEQ ID NO: 108)

(SEQ ID NO: 109)
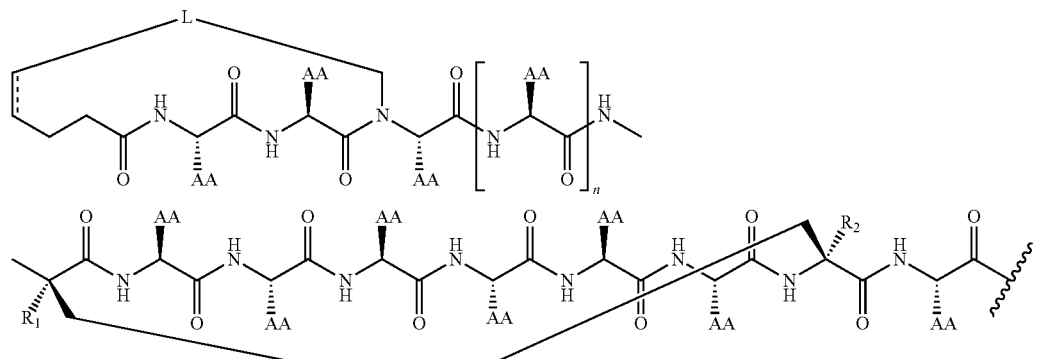
(SEQ ID NO: 110)
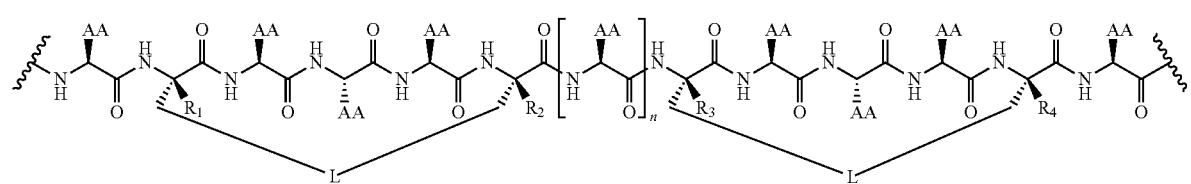
(SEQ ID NO: 111)
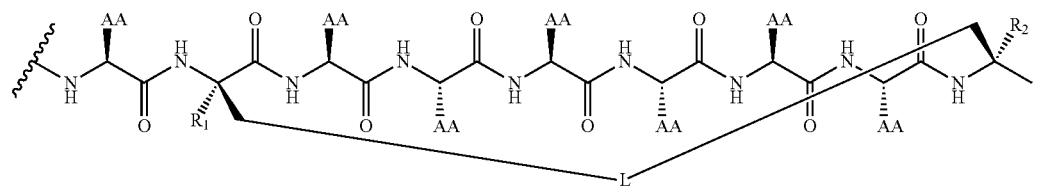
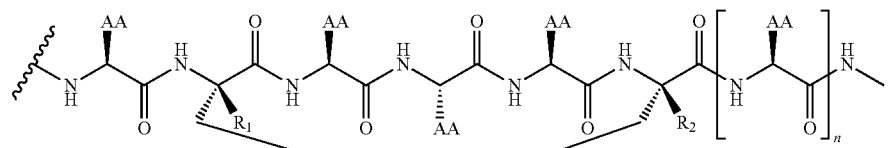
(SEQ ID NO: 112)
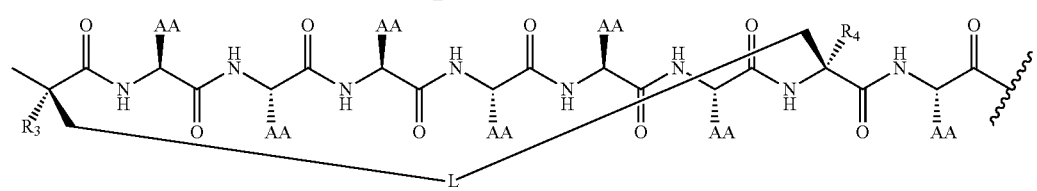
(SEQ ID NO: 113)
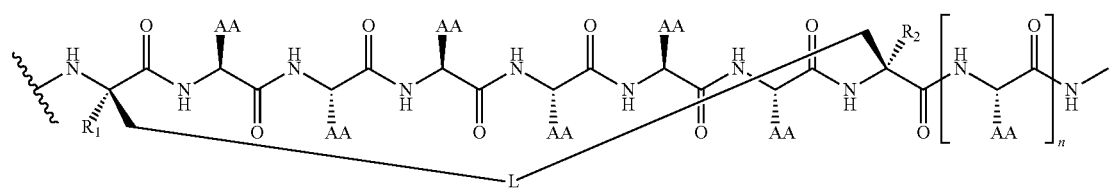

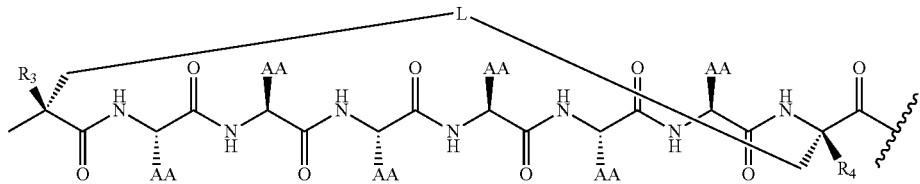
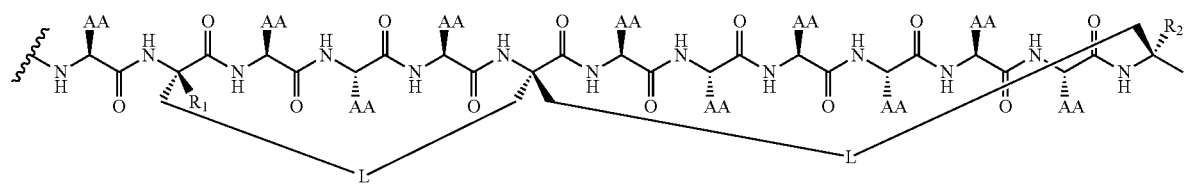
(SEQ ID NO: 114)
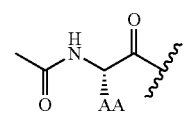
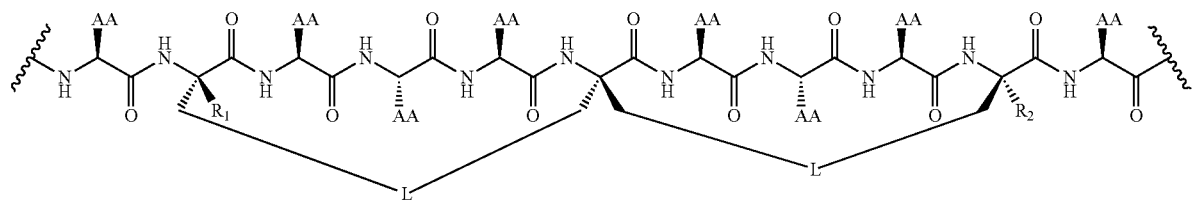
(SEQ ID NO: 115)
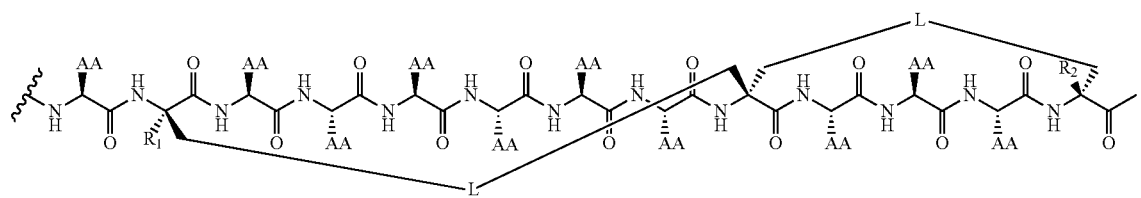
(SEQ ID NO: 116)
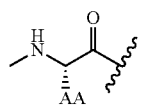
(SEQ ID NO: 1171)
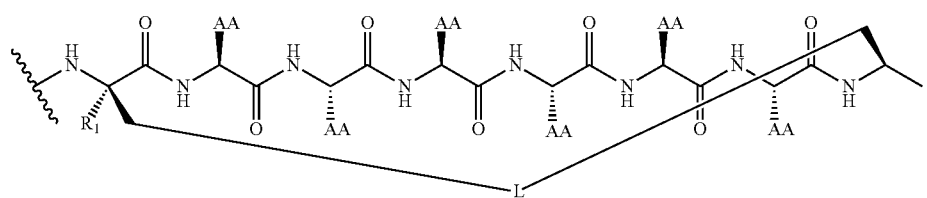

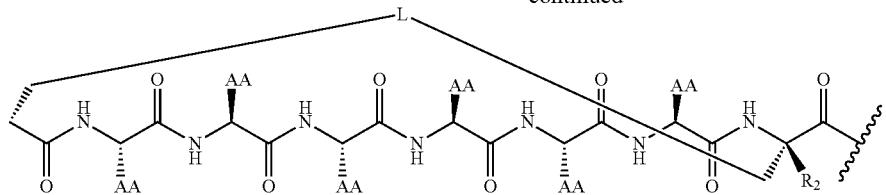

wherein "AA" represents any natural or non-natural amino acid side chain and "⌇" is [D]$_v$, [E], as defined above, and n is an integer between 0 and 20, 50, 100, 200, 300, 400 or 500. In some embodiments, n is 0. In other embodiments, n is less than 50.

Exemplary embodiments of the macrocycle-forming linker L are shown below.

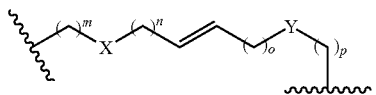

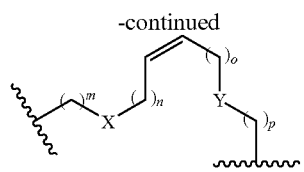

Exemplary embodiments of peptidomimetic macrocycles of the invention are shown below (SEQ ID NOS 1-6, respectively, in order of appearance):

Formula IV/IVa

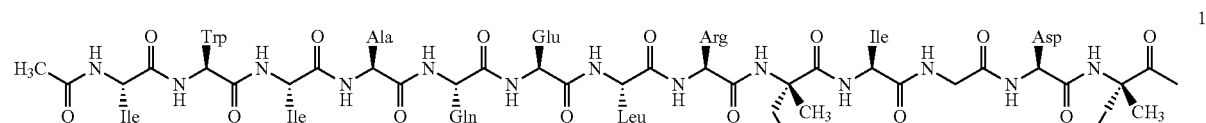

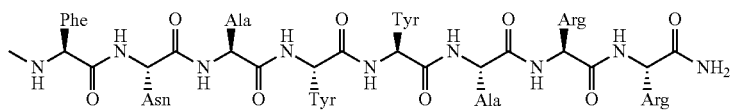

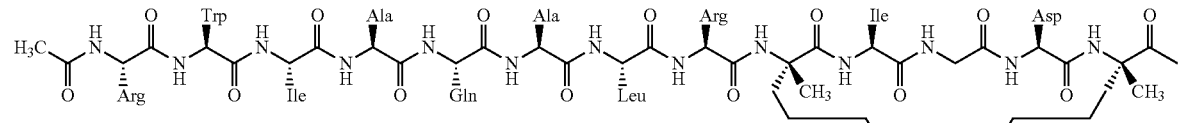

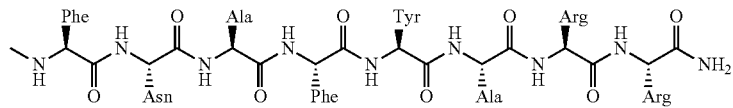

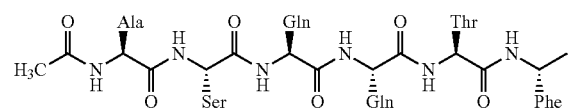

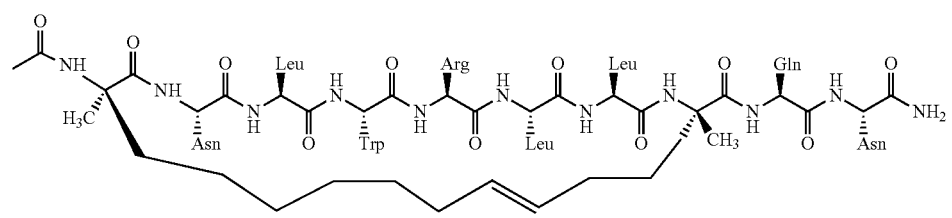

-continued

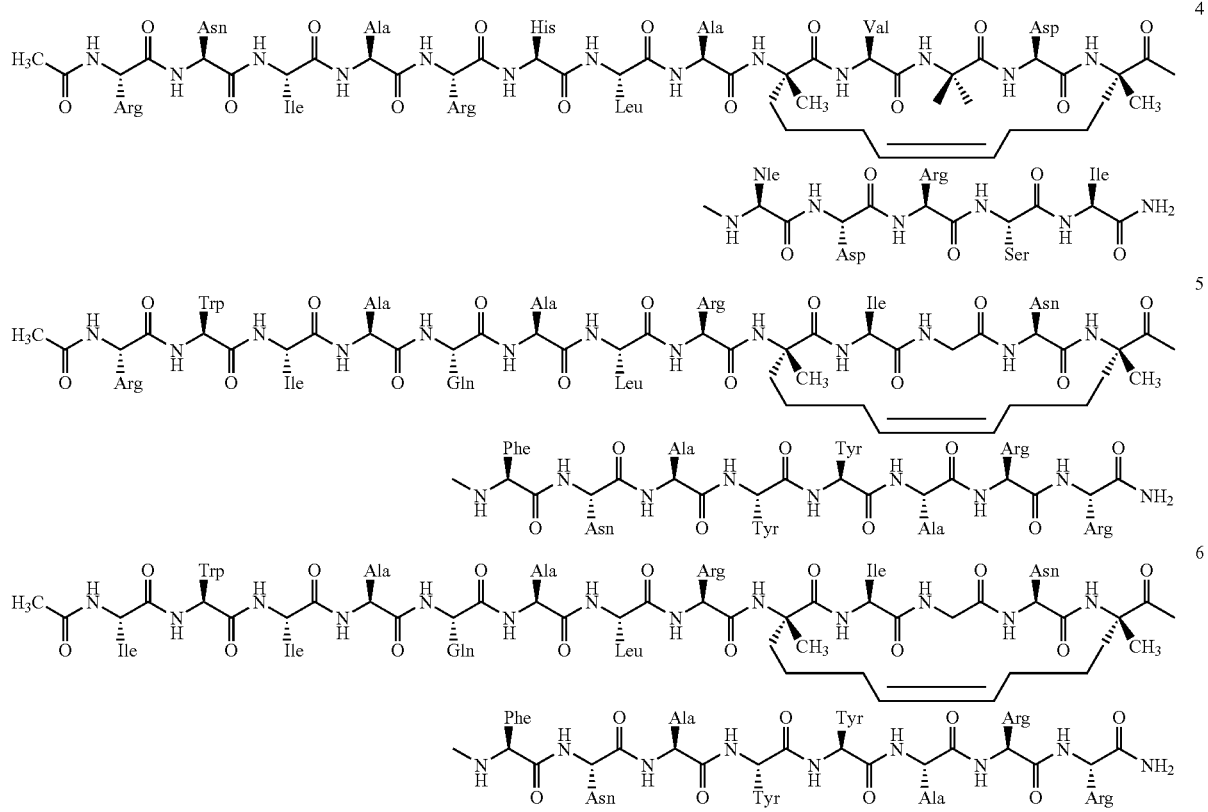

Formula IV/IVa

In other embodiments, the invention provides peptidomimetic macrocycles of Formula (IV) or (IVa):

Formula (IV)

(SEQ ID NO: 118)

Formula (IVa)

(SEQ ID NO: 119)

wherein:

each A, C, D, and E is independently a natural or non-natural amino acid;

B is a natural or non-natural amino acid, amino acid analog,

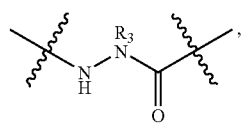

[—NH-$L_3$-CO—], [—NH-$L_3$-$SO_2$—], or [—NH-$L_3$-];

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-, or part of a cyclic structure with an E residue;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$;

V and w are independently integers from 1-1000;
u, x, y and z are independently integers from 0-10; and
n is an integer from 1-5.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments of the compound of Formula IV or IVa; x+y+z is 1. In some embodiments of the invention, x+y+z is 2. In other embodiments of the invention, x+y+z is 3, 4, 5, 6, 7, 8, 9 or 10. Each occurrence of A, B, C, D or E in a macrocycle or macrocycle precursor of the invention is independently selected. For example, a sequence represented by the formula $[A]_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges.

In some embodiments, the peptidomimetic macrocycle of the invention comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

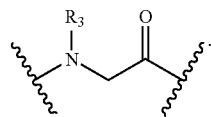

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Exemplary embodiments of the macrocycle-forming linker L are shown below.

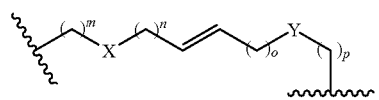

where X, Y = —CH$_2$—, O, S, or NH
m, n, o, p = 0-10

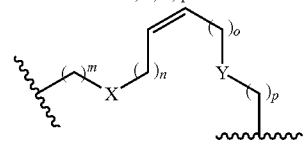

where X, Y = —CH$_2$—, O, S, or NH
m, n, o, p = 0-10

Design of the Peptidomimetic Macrocycles of the Invention

Any protein or polypeptide with a known primary amino acid sequence which contains a secondary structure believed to impart biological activity is useful as a peptidomimetic precursor. For example, the sequence of the polypeptide can be analyzed and amino acid analogs containing groups reactive with macrocyclization reagents can be substituted at the appropriate positions. The appropriate positions are determined by ascertaining which molecular surface(s) of the secondary structure is (are) required for biological activity and, therefore, across which other surface(s) the macrocycle forming linkers of the invention can form a macrocycle without sterically blocking the surface(s) required for biological activity. Such determinations are made using methods such as X-ray crystallographic analysis (or other structural methods) of complexes between the secondary structure and a natural binding partner to visualize residues (and surfaces) critical for activity; by sequential mutagenesis of residues in the secondary structure to functionally identify residues (and surfaces) critical for activity; or by other methods. By such determinations, the appropriate amino acids are substituted with the amino acids analogs and macrocycle-forming linkers of the invention. For example, for an α-helical secondary structure, one surface of the helix (e.g., a molecular surface extending longitudinally along the axis of the helix and radially 45-135° about the axis of the helix) may be required to make contact with another biomolecule in vivo or in vitro for biological activity. In such a case, a macrocycle-forming linker is designed to link two α-carbons of the helix while extending longitudinally along the surface of the helix in a portion of that surface not directly required for activity.

In some embodiments, the peptide sequence is derived from the BCL-2 family of proteins. The BCL-2 family is defined by the presence of up to four conserved BCL-2 homology (BH) domains designated BH1, BH2, BH3, and BH4, all of which include α-helical segments (Chittenden et al. (1995), *EMBO* 14:5589; Wang et al. (1996), *Genes Dev.* 10:2859). Anti-apoptotic proteins, such as BCL-2 and BCL-$X_L$, display sequence conservation in all BH domains. Pro-apoptotic proteins are divided into "multidomain" family members (e.g., BAK, BAX), which possess homology in the BH1, BH2, and BH3 domains, and "BH3-domain only" family members (e.g., BID, BAD, BIM, BIK, NOXA, PUMA), that contain sequence homology exclusively in the BH3 amphipathic α-helical segment. BCL-2 family members have the capacity to form homo- and heterodimers, suggesting that competitive binding and the ratio between pro- and anti-apoptotic protein levels dictates susceptibility to death stimuli. Anti-apoptotic proteins function to protect cells from pro-apoptotic excess, i.e., excessive programmed cell death. Additional "security" measures include regulating transcription of pro-apoptotic proteins and maintaining them as inactive conformers, requiring either proteolytic activation, dephosphorylation, or ligand-induced conformational change to activate pro-death functions. In certain cell types, death signals received at the plasma membrane trigger apoptosis via a mitochondrial pathway. The mitochondria can serve as a gatekeeper of cell death by sequestering cytochrome c, a critical component of a cytosolic complex which activates caspase 9, leading to fatal downstream proteolytic events. Multidomain proteins such as BCL-2/BCL-$X_L$ and BAK/BAX play dueling roles of guardian and executioner at the mitochondrial membrane, with their activities further regulated by upstream BH3-only members of the BCL-2 family. For example, BID is a member of the BH3-domain only family of pro-apoptotic proteins, and transmits death signals received at the plasma membrane to effector pro-apoptotic proteins at the mitochondrial membrane. BID has the capability of interacting with both pro- and anti-apoptotic proteins, and upon activation by caspase 8, triggers cytochrome c release and mitochondrial apoptosis. Deletion and mutagenesis studies determined that the amphipathic α-helical BH3 segment of pro-apoptotic family members may function as a death domain and thus may represent a critical structural motif for interacting with multidomain apoptotic proteins. Structural studies have shown that the BH3 helix can interact with anti-apoptotic proteins by inserting into a hydrophobic groove formed by the interface of BH 1, 2 and 3 domains. Activated BID can be bound and sequestered by anti-apoptotic proteins (e.g., BCL-2 and BCL-$X_L$) and can trigger activation of the pro-apoptotic proteins BAX and BAK, leading to cytochrome c release and a mitochondrial apoptosis program. BAD is also a BH3-domain only pro-apoptotic family member whose expression triggers the activation of BAX/BAK. In contrast to BID, however, BAD displays preferential binding to anti-apoptotic family members, BCL-2 and BCL-$X_L$. Whereas the BAD BH3 domain exhibits high affinity binding to BCL-2, BAD BH3 peptide is unable to activate cytochrome c release from mitochondria in vitro, suggesting that BAD is not a direct activator of BAX/BAK. Mitochondria that over-express BCL-2 are resistant to BID-induced cytochrome c release, but co-treatment with BAD can restore BID sensitivity. Induction of mitochondrial apoptosis by BAD appears to result from either: (1) displacement of BAX/BAK activators, such as BID and BID-like proteins, from the BCL-2/BCL-XL binding pocket, or (2) selective occupation of the BCL-2/BCL-XL binding pocket by BAD to prevent sequestration of BID-like proteins by anti-apoptotic proteins. Thus, two classes of BH3-domain only proteins have emerged, BID-like proteins that directly activate mitochondrial apoptosis, and BAD-like proteins, that have the capacity to sensitize mitochondria to BID-like pro-apoptotics by occupying the binding pockets of multidomain anti-apoptotic proteins. Various α-helical domains of BCL-2 family member proteins amendable to the methodology disclosed herein have been disclosed (Walensky et al. (2004), *Science* 305:1466; and Walensky et al., U.S. Patent Publication No. 2005/0250680, the entire disclosures of which are incorporated herein by reference).

In other embodiments, the peptide sequence is derived from the tumor suppressor p53 protein which binds to the oncogene protein MDM2. The MDM2 binding site is localized within a region of the p53 tumor suppressor that forms an α helix. In U.S. Pat. No. 7,083,983, the entire contents of which are incorporated herein by reference, Lane et al. disclose that the region of p53 responsible for binding to MDM2 is represented approximately by amino acids 13-31 (PLSQETFSDLWKLLPENNV (SEQ ID NO: 7)) of mature human P53 protein. Other modified sequences disclosed by Lane are also contemplated in the instant invention. Furthermore, the interaction of p53 and MDM2 has been discussed by Shair et al. (1997), *Chem. & Biol.* 4:791, the entire contents of which are incorporated herein by reference, and mutations in the p53 gene have been identified in virtually half of all reported cancer cases. As stresses are imposed on a cell, p53 is believed to orchestrate a response that leads to either cell-cycle arrest and DNA repair, or programmed cell death. As well as mutations in the p53 gene that alter the function of the p53 protein directly, p53 can be altered by changes in MDM2. The MDM2 protein has been shown to bind to p53 and disrupt transcriptional activation by associating with the transactivation domain of p53. For example, an 11 amino-acid peptide derived from the transactivation domain of p53 forms an amphipathic α-helix of 2.5 turns that inserts into the MDM2 crevice. Thus, in some embodiments, novel α-helix structures generated by the method of the present invention are engineered to generate structures that bind tightly to the helix acceptor and disrupt native protein-protein interactions. These structures are then screened using high throughput techniques to identify optimal small molecule peptides. The novel structures that disrupt the MDM2 interaction are useful for many applications, including, but not limited to, control of soft tissue sarcomas (which over-expresses MDM2 in the presence of wild type p53). These cancers are then, in some embodiments, held in check with small molecules that intercept MDM2, thereby preventing suppression of p53. Additionally, in some embodiments, small molecules disrupters of MDM2-p53 interactions are used as adjuvant therapy to help control and modulate the extent of the p53 dependent apoptosis response in conventional chemotherapy.

Non-limiting exemplary list of suitable peptide sequences for use in the present invention are given below in Tables 1-4.

TABLE 1

Exemplary human sequences which target the BH3 binding site and are implicated in cancers, autoimmune disorders, metabolic diseases and other human disease conditions.

| Name | Sequence (bold = critical residues) | Cross-linked Sequence (X = x-link residue) |
| --- | --- | --- |
| BH3 peptides | (column discloses SEQ ID NOS 8-30, respectively, in order of appearance) | (column discloses SEQ ID NOS 31-53, respectively, in order of appearance) |
| BID-BH3 | QEDIIRNIARHLAQVGDSMDRSIPP | QEDIIRNIARHLAXVGDXMDRSIPP |
| BIM-BH3 | DNRPEIWIAQELRRIGDEFNAYYAR | DNRPEIWIAQELRXIGDXFNAYYAR |
| BAD-BH3 | NLWAAQRYGRELRRMSDEFVDSFKK | NLWAAQRYGRELRXMSDXFVDSFKK |
| PUMA-BH3 | EEQWAREIGAQLRRMADDLNAQYER | EEQWAREIGAQLRXMADXLNAQYER |
| Hrk-BH3 | RSSAAQLTAARLKALGDELHQRTM | RSSAAQLTAARLKXLGDXLHQRTM |
| NOXAA-BH3 | AELPPEFAAQLRKIGDKVYCTW | AELPPEFAAQLRXIGDXVYCTW |
| NOXAB-BH3 | VPADLKDECAQLRRIGDKVNLRQKL | VPADLKDECAQLRXIGDXVNLRQKL |
| BMF-BH3 | QHRAEVQIARKLQCIADQFHRLHT | QHRAEVQIARKLQXIADXFHRLHT |
| BLK-BH3 | SSAAQLTAARLKALGDELHQRT | SSAAQLTAARLKXLGDXLHQRT |
| BIK-BH3 | CMEGSDALALRLACIGDEMDVSLRA | CMEGSDALALRLAXIGDXMDVSLRA |

TABLE 1-continued

Exemplary human sequences which target the BH3 binding site and are implicated in cancers, autoimmune disorders, metabolic diseases and other human disease conditions.

| Name | Sequence (bold = critical residues) | Cross-linked Sequence (X = x-link residue) |
|---|---|---|
| Bnip3 | DIERRKEVESILKKNSDWIWDWSS | DIERRKEVESILKXNSDXIWDWSS |
| BOK-BH3 | GRLAEVCAVLLRLGDELEMIRP | GRLAEVCAVLLXLGDXLEMIRP |
| BAX-BH3 | PQDASTKKSECLKRIGDELDSNMEL | PQDASTKKSECLKXIGDXLDSNMEL |
| BAK-BH3 | PSSTMGQVGRQLAIIGDDINRR | PSSTMGQVGRQLAXIGDXINRR |
| BCL2L1-BH3 | KQALREAGDEFELR | KQALRXAGDXFELR |
| BCL2-BH3 | LSPPVVHLALALRQAGDDFSRR | LSPPVVHLALALRXAGDXFSRR |
| BCL-XL-BH3 | EVIPMAAVKQALREAGDEFELRY | EVIPMAAVKQALRXAGDXFELRY |
| BCL-W-BH3 | PADPLHQAMRAAGDEFETRF | PADPLHQAMRXAGDXFETRF |
| MCL1-BH3 | ATSRKLETLRRVGDGVQRNHETA | ATSRKLETLRXVGDXVQRNHETA |
| MTD-BH3 | LAEVCTVLLRLGDELEQIR | LAEVCTVLLXLGDXLEQIR |
| MAP-1-BH3 | MTVGELSRALGHENGSLDP | MTVGELSRALGXENGXLDP |
| NIX-BH3 | VVEGEKEVEALKKSADWVSDWS | VVEGEKEVEALKXSADXVSDWS |
| 4ICD(ERBB4)-BH3 | SMARDPQRYLVIQGDDRMKL | SMARDPQRYLVXQGDXRMKL |

TABLE 2

Exemplary human sequences which target the BH3 binding site and are implicated in cancers, autoimmune disorders, metabolic diseases and other human disease conditions.

| Name | Sequence (bold = critical residues) | Cross-linked Sequence (X = x-link residue) |
|---|---|---|
| BH3 peptides | (column discloses SEQ ID NOS 8-30, respectively, in order of appearance) | (column discloses SEQ ID NOS 54-76, respectively, in order of appearance) |
| BID-BH3 | QEDIIRNIARHLAQVGDSMDRSIPP | QEDIIRNIXRHLXQVGDSMDRSIPP |
| BIM-BH3 | DNRPEIWIAQELRRIGDEFNAYYAR | DNRPEIWIXQELXRIGDEFNAYYAR |
| BAD-BH3 | NLWAAQRYGRELRRMSDEFVDSFKK | NLWAAQRYXRELXRMSDEFVDSFKK |
| PUMA-BH3 | EEQWAREIGAQLRRMADDLNAQYER | EEQWAREIXAQLXRMADDLNAQYER |
| Hrk-BH3 | RSSAAQLTAARLKALGDELHQRTM | RSSAAQLTXARLXALGDELHQRTM |
| NOXAA-BH3 | AELPPEFAAQLRKIGDKVYCTW | AELPPEFXAQLXKIGDKVYCTW |
| NOXAB-BH3 | VPADLKDECAQLRRIGDKVNLRQKL | VPADLKDEXAQLXRIGDKVNLRQKL |
| BMF-BH3 | QHRAEVQIARKLQCIADQFHRLHT | QHRAEVQIXRKLXCIADQFHRLHT |
| BLK-BH3 | SSAAQLTAARLKALGDELHQRT | SSAAQLTXARLXALGDELHQRT |
| BIK-BH3 | CMEGSDALALRLACIGDEMDVSLRA | CMEGSDALXLRLXCIGDEMDVSLRA |
| Bnip3 | DIERRKEVESILKKNSDWIWDWSS | DIERRKEVXSILXKNSDWIWDWSS |
| BOK-BH3 | GRLAEVCAVLLRLGDELEMIRP | GRLAEVXAVLXRLGDELEMIRP |
| BAX-BH3 | PQDASTKKSECLKRIGDELDSNMEL | PQDASTKKXECLXRIGDELDSNMEL |
| BAK-BH3 | PSSTMGQVGRQLAIIGDDINRR | PSSTMGQVXRQLXIIGDDINRR |
| BCL2L1-BH3 | KQALREAGDEFELR | XQALXEAGDEFELR |
| BCL2-BH3 | LSPPVVHLALALRQAGDDFSRR | LSPPVVHLXLALXQAGDDFSRR |

TABLE 2-continued

Exemplary human sequences which target the BH3 binding site and are implicated in cancers, autoimmune disorders, metabolic diseases and other human disease conditions.

| Name | Sequence (bold = critical residues) | Cross-linked Sequence (X = x-link residue) |
|---|---|---|
| BCL-XL-BH3 | EVIPMAAVKQALREAGDEFELRY | EVIPMAAVXQALXEAGDEFELRY |
| BCL-W-BH3 | PADPLHQAMRAAGDEFETRF | PADPLXQAMXAAGDEFETRF |
| MCL1-BH3 | ATSRKLETLRRVGDGVQRNHETA | ATSRKXETLXRVGDGVQRNHETA |
| MTD-BH3 | LAEVCTVLLRLGDELEQIR | LAEVXTVLXRLGDELEQIR |
| MAP-1-BH3 | MTVGELSRALGHENGSLDP | MTVGELXRALXHENGSLDP |
| NIX-BH3 | VVEGEKEVEALKKSADWVSDWS | VVEGEKEXEALXKSADWVSDWS |
| 4ICD(ERBB4)-BH3 | SMARDPQRYLVIQGDDRMKL | SMARDPXRYLXIQGDDRMKL |

TABLE 3

Exemplary human sequences which target the p53 binding site of MDM2/X and are implicated in cancers.

| Name | Sequence (bold = critical residues) | Cross-linked Sequence (X = x-link residue) |
|---|---|---|
| P53 peptides | (column discloses SEQ ID NO: 77, respectively) | (column discloses SEQ ID NOS 78-82, respectively, in order of appearance) |
| hp53 peptide 1 | LSQETFSDLWKLLPEN | LSQETFSDXWKLLPEX |
| hp53 peptide 2 | LSQETFSDLWKLLPEN | LSQEX FSDLWKXLPEN |
| hp53 peptide 3 | LSQETFSDLWKLLPEN | LSQXTFSDLW XLLPEN |
| hp53 peptide 4 | LSQETFSDLWKLLPEN | LSQETF XDLWKLLXEN |
| hp53 peptide 5 | LSQETFSDLWKLLPEN | QSQQTF XNLWRLLXQN |

TABLE 4 exemplary sequences which target human G protein-coupled receptors and are implicated in numerous human disease conditions (Tyndall et al. (2005), Chem. Rev. 105:793-826).

| Name | Sequence (bold = critical residues) | Cross-linked Sequence (X = x-link residue) |
|---|---|---|
| GPCR peptide ligands | (column discloses SEQ ID NOS 83-88, respectively, in order of appearance) | (column discloses SEQ ID NOS 89-94, respectively, in order of appearance) |
| Angiotensin II | DRVYIHPF | DRX Y XHPF |
| Bombesin | EQRLGNQWAVGHLM | EQRLGNXWAVGHL X |
| Bradykinin | RPPGFSPFR | RPPXFSPFRX |
| C5a | ISHKDMQLGR | ISHKDM XLGRX |

TABLE 4-continued exemplary sequences which target human G protein-coupled receptors and are implicated in numerous human disease conditions (Tyndall et al. (2005), Chem. Rev. 105:793-826).

| Name | Sequence (bold = critical residues) | Cross-linked Sequence (X = x-link residue) |
|---|---|---|
| C3a | ARASHLGLAR | ARASHL XLARX |
| α-melanocyte stimulating hormone | SYSMEHFRWGKPV | SYSMXHFRWXKPV |

Preparation of Peptidomimetic Macrocycles and Macrocycle Precursors

In general, the first step in preparing peptidomimetic macrocycles of the invention is the synthesis of a peptidomimetic precursor that contains amino acids with moieties capable of undergoing metathesis. The peptidomimetic precursor may be purified or not purified following its synthesis. The next step is to contact the peptidomimetic precursor with a macrocycle-forming reagent such as a ring-closing metathesis catalyst to generate a crude peptidomimetic macrocycle containing at least one cross link between two amino acids. Subsequently, the crude peptidomimetic macrocycle is purified to remove impurities and metals, for example metal residue derived from the catalyst.

Crude peptidomimetic macrocycles or macrocycle precursors may be prepared by any of a variety of published methods. Standard deprotection and coupling reactions for synthesizing the desired peptidomimetic precursors are known. They may be synthesized, for example, by solution phase or solid-phase methods, and can contain both naturally-occurring and non-naturally-occurring amino acids (see, for example, Hunt, "The Non-Protein Amino Acids" in *Chemistry and Biochemistry of the Amino Acids*, edited by G. C. Barrett, Chapman and Hall, 1985). Chemical synthetic methods may be used, such as described in Fields et al., Chapter 3 in *Synthetic Peptides: A User's Guide*, ed. Grant, W. H. Freeman & Co., New York, N.Y., 1992, p. 77. Hence, for example, peptides are synthesized using the automated Merrifield techniques of solid phase synthesis with the amine protected by either tBoc or Fmoc chemistry using side chain protected amino acids on, for example, an automated peptide synthesizer (e.g., Applied Biosystems (Foster City, Calif.), Model 430A, 431, or 433).

One example of a solution phase peptide synthesis coupling protocol includes the use of N,N-dicyclohexylcarbodiimide (DCC)/1-hydroxybenzotriazole (HOBT) as a peptide coupling agent (see, M. Bordansky, Petpide Chemistry, Springer Verlag, N.Y., 1988, pp. 55-146 the entire contents of which are incorporated herein by reference). Other peptide synthesis techniques have been extensively discussed in "Bioorganic Chemistry" as cited herein.

One manner of producing the peptidomimetic precursors and peptidomimetic macrocycles described herein uses solid phase peptide synthesis (SPPS). The C-terminal amino acid is attached to a cross-linked polystyrene resin via an acid labile bond with a linker molecule. This resin is insoluble in the solvents used for synthesis, making it relatively simple and fast to wash away excess reagents and by-products. The N-terminus is protected with the Fmoc group, which is stable in acid, but removable by base. Side chain functional groups are protected as necessary with base stable, acid labile groups.

Longer peptidomimetic precursors are produced, for example, by conjoining individual synthetic peptides using native chemical ligation. Alternatively, the longer synthetic peptides are biosynthesized by well known recombinant DNA and protein expression techniques. Such techniques are provided in well-known standard manuals with detailed protocols. To construct a gene encoding a peptidomimetic precursor, the amino acid sequence is reverse translated to obtain a nucleic acid sequence encoding the amino acid sequence, preferably with codons that are optimum for the organism in which the gene is to be expressed. Next, a synthetic gene is made, typically by synthesizing oligonucleotides which encode the peptide and any regulatory elements, if necessary. The synthetic gene is inserted in a suitable cloning vector and transfected into a host cell. The peptide is then expressed under suitable conditions appropriate for the selected expression system and host. The peptide is purified and characterized by standard methods.

The peptidomimetic precursors can also be made, for example, in a high-throughput, combinatorial fashion using, for example, a high-throughput polychannel combinatorial synthesizer (e.g., Thuramed TETRAS multichannel peptide synthesizer from CreoSalus, Louisville, Ky. or Model Apex 396 multichannel peptide synthesizer from AAPPTEC, Inc., Louisville, Ky.).

In some embodiments, the —NH moiety of the amino acid is protected using a protecting group, including without limitation -Fmoc and -Boc. In other embodiments, the amino acid is not protected prior to synthesis of the peptidomimetic macrocycle.

The choice of a particular synthetic technique will depend upon the particular structures to be synthesized. Alternative but equivalent protecting groups, leaving groups or reagents are substituted, and certain synthetic steps are performed in alternative sequences or orders to produce the desired compounds. Synthetic chemistry transformations and protecting group methodologies (protection and deprotection) useful in synthesizing the compounds described herein include, for example, those such as described in Larock, *Comprehensive Organic Transformations*, VCH Publishers (1989); Greene and Wuts, *Protective Groups in Organic Synthesis*, 2d. Ed., John Wiley and Sons (1991); Fieser and Fieser, *Fieser and Fieser's Reagents for Organic Synthesis*, John Wiley and Sons (1994); and Paquette, ed., *Encyclopedia of Reagents for Organic Synthesis*, John Wiley and Sons (1995), and subsequent editions thereof.

Variations of the peptidomimetic precursors and peptidomimetic macrocycles may be envisioned. In some embodiments, variations in sequence residues are possible. For example, preparation of the peptidomimetics macrocycles and macrocycle precursors can include substitution of any of the residues indicated by "X" in Tables 1, 2, 3 or 4 with a residue capable of forming a crosslinker with a second residue in the same molecule or a precursor of such a residue.

Peptidomimetic macrocycles and peptidomimetic precursors may include both natural and non-natural amino acids. The natural amino acids include Glycine, Alanine, Valine, Leucine, Isoleucine, Proline, Phenylalanine, Tryptophan, Methionine, Serine, Threonine, Cysteine, Tyrosine, Asparagine, Glutamine, Aspartic acid, Glutamic acid, Lysine, Arginine and Histidine. Other less commonly found natural amino acids may also be used such as selenocysteine and pyrolysine. There are over 700 known non-natural amino acids any of which may be included in the peptide precursors for use in the present invention. These also include analogs of natural and non-natural amino acids (see, for example, S. Hunt, The Non-Protein Amino Acids: In Chemistry and Biochemistry of the Amino Acids, edited by G. C. Barrett, Chapman and Hall, 1985). Some examples of non-natural amino acids are L-propargylglycine, beta-Alanine, D-Alanine, 4-Hydroxy proline, Desmosine, D-Glutamic acid, gamma-Aminobutyric acid, beta-cyanoalanine, Norvaline, norleucine, tert-leucine, alpha-amino butyric acid, 4-(E)-Butenyl-4(R)-methyl-N-methyl-L-threonine, N-Methyl-L-leucine, and Statine. Peptidomimetic macrocycles and peptidomimetic precursors can also include amino acids capable of pi-stacking such as epsilon-(3,5-dinitrobenzoyl)-lysine.

Peptidomimetic precursors suitable for use can also be derivatized to include amino acids that are hydroxylated, phosphorylated, sulfonated, glycosylated, disulfide bonded or otherwise derivatized. The amino acids may also include functional groups. Non-limiting examples of functional groups include alkyl, alcohol, thiol, ketone, aldehyde, ester, ether, amine, imine, amide, nitro acid, carboxylic acid, disulfide, carbonate, carboalkoxy acid, isocyanate, carbodiimide, carboalkoxy and halogen functional groups.

In other embodiments, alpha, alpha-disubstituted amino acids (e.g. alpha-methyl or alpha-vinyl amino acids) are utilized as precursors for crosslinker formation. Synthesis and some examples of alpha-methyl, alpha-alkylolefin amino acids are discussed in U.S. Pat. No. 7,192,713. For example, methyl iodide and sodium tetramethyl disilylazide can be used to treat commercially available lactone to generate the methylated lactone. Subsequent treatment with a homoallyl iodide in the presence of potassium tetramethyl disilylazide will result in the homoallyloxazinone. Sodium metal reduction, acid hydrolysis, and protection with Fmoc-NHS can generate the protected alpha-methyl, alpha-alkylolefin for use in the synthesis of peptidomimetics.

In some embodiments, a variety of homoallyl reagents can be utilized to generate amino acids having different lengths of olefin chains, which can be further functionalized with moieties including, but not limited to, branched or linear alkyl moieties, hydroxyl moieties, thiol moieties, amines, carboxyl moieties and substituted or unsubstituted aryl moieties, to name a few.

In some embodiments the amino acids and amino acid analogs are of the D-configuration. In other embodiments they are of the L-configuration. In another embodiment, natural and non-natural amino acids with a combination of D-configuration and L-configuration can be used.

The peptidomimetic macrocycle and precursor can comprise one or more moieties such as a fluorescent moiety, affinity label, targeting moiety, or a radioisotope. For example, the amino termini of a macrocycle or precursor can be further derivatized with labels such as fluorescein isothiocyanate (FITC) or biotin conjugated-lysine to generate labeled peptidomimetic macrocycles for cell permeability studies and biochemical assays, respectively. Other useful variations include but are not limited to fluorescent amino acids such as a tryptophan added to the C-terminus of the macrocycle or precursor to serve as a UV label for purification and concentration determination purposes or elimination of an N-terminal glutamic acid to increase the overall pI of the macrocycle or precursor to potentially facilitate cell penetration. Other moieties useful for the peptidomimetic macrocycle and precursors comprise a therapeutic agent. Non-limiting examples of therapeutic agents include small molecules, peptides, antibodies, ribozymes and antisense oligonucleotides.

To facilitate cellular uptake, in some embodiments, D and/or E in the compound of the invention are further modified. For example, in some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration. In other embodiments, at least one of [D] and [E] in the compound of the invention represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers.

For the peptidomimetic macrocycles and precursors, any of the macrocycle-forming linkers described herein may be used in any combination with any of the sequences shown in Tables 1-4 and also with any of the R— substituents indicated herein.

In some embodiments, the peptidomimetic macrocycle comprises at least one α-helix motif. For example, A, B and/or C in the compound of the invention include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

For example, the preparation of peptidomimetic macrocycles of Formula I is described in Schafmeister et al., J. Am. Chem. Soc. 122:5891-5892 (2000); Schafmeister & Verdine, J. Am. Chem. Soc. 122:5891 (2005); Walensky et al., Science 305:1466-1470 (2004); U.S. Pat. No. 7,192,713; and PCT application WO 2008/121767. The α,α-disubstituted amino acids and amino acid precursors disclosed in the cited references may be employed in synthesis of the peptidomimetic macrocycle precursor polypeptides. Following incorporation of such amino acids into precursor polypeptides, the terminal olefins are reacted with a metathesis catalyst, leading to the formation of the peptidomimetic macrocycle.

In other embodiments, the peptidomimetic macrocycles of the invention are of Formula IV or IVa. Methods for the preparation of such macrocycles are described, for example, in U.S. Pat. No. 7,202,332, incorporated herein in its entirety.

In the peptidomimetic macrocycles of the invention, at least one of $R_1$ and $R_2$ is alkyl, alkenyl, alkynyl, arylalkyl, cycloalkyl, cycloalkylalkyl, heteroalkyl, or heterocycloalkyl, unsubstituted or substituted with halo-. In some embodiments, both $R_1$ and $R_2$ are independently alkyl, alkenyl, alkynyl, arylalkyl, cycloalkyl, cycloalkylalkyl, heteroalkyl, or heterocycloalkyl, unsubstituted or substituted with halo-. In some embodiments, at least one of A, B, C, D or E is an α,α-disubstituted amino acid. In one example, B is an α,α-disubstituted amino acid. For instance, at least one of A, B, C, D or E is 2-aminoisobutyric acid.

For example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl. The macrocyclization reagent may be a Cu reagent or a Ru reagent.

In some embodiments, the peptidomimetic precursor is purified prior to the contacting step. In other embodiments, the peptidomimetic macrocycle is purified after the contacting step. In still other embodiments, the peptidomimetic macrocycle is refolded after the contacting step. The method may be performed in solution, or, alternatively, the method may be performed on a solid support.

Also envisioned herein is performing the method of the invention in the presence of a target macromolecule that binds to the peptidomimetic precursor or peptidomimetic macrocycle under conditions that favor said binding. In some embodiments, the method is performed in the presence of a target macromolecule that binds preferentially to the peptidomimetic precursor or peptidomimetic macrocycle under conditions that favor said binding. The method may also be applied to synthesize a library of peptidomimetic macrocycles.

In some embodiments, the contacting step is performed in a solvent selected from the group consisting of protic solvent, aqueous solvent, organic solvent, and mixtures thereof. For example, the solvent may be chosen from the group consisting of $H_2O$, THF, THF/$H_2O$, tBuOH/$H_2O$, DMF, DIPEA, $CH_3CN$ or $CH_2Cl_2$, $ClCH_2CH_2Cl$ or a mixture thereof. The solvent may be a solvent which favors helix formation.

Ring-Closing Metathesis Catalysts

For embodiments comprising two olefins as the amino acid moieties to be cross-linked, ring-closing olefin metathesis may be used to perform the cyclization reaction. In one embodiment, the olefin metathesis reaction involves a ring-closing olefin metathesis reaction. A ring-closing olefin metathesis utilizes an olefin metathesis reaction to form a macrocycle. In this reaction, two double bonds within a chain are connected.

Suitable catalysts that are useful in generating the peptidomimetic macrocycles include any catalyst capable of catalyzing the ring closing metathesis of a peptidomimetic precursor. Non-limiting examples of suitable catalysts include the ruthenium and osmium carbene complexes discussed in U.S. Pat. Nos. 5,312,940; 5,342,909; 5,811,515; 6,111,121; 6,921,735; EP1180108B1, each of which is incorporated herein by reference. Suitable catalysts include stabilized, late transition metal carbene complex catalysts such as Group VIII transition metal carbene catalysts that include Ru and Os metal carbene catalysts. For Ru and Os metal carbene catalysts, the Ru and Os metal centers are in the +2 oxidation state, have an electron count of 16, and are pentacoordinated. Other appropriate ring closing metathesis catalysts may be utilized. Discussions of metathesis reactions can be found in Grubbs et al., "Ring Closing Metathesis and Related Processes in Organic Synthesis" Acc. Chem. Res. 1995, 28, 446-452; Hoveyda et al., "Ru Complexes Bearing Bidentate Carbenes: From Innocent Curiosity to Uniquely Effective Catalysts for Olefin Metathesis," Org. Biomolec. Chem. 2:8-23 (2004); Trnka et al., "The Development of L2X2Tu=CHR Olefin Metathesis Catalysts: An Organometallic Success Story," Accounts Chem. Res. 34:18-29 (2001), which are hereby incorporated by reference in their entirety.

The metal center may have a ligand environment that includes anionic ligands and neutral or electron donating ligands. The anionic ligands may be any ligand which when removed from a metal center in its closed shell electron configuration has a negative charge. Non-limiting examples of ligands include halogens containing groups; alkyl; aryl; alkenyl; alkylaryl; arylalkyl; hydrocarboxy; amides, phosphides; sulfides; silylalkyls; diketones; borohydrides; and carboxylates; phosphine, sulfonated phosphine, phosphite, phosphinite, phosphonite, arsine, stibine, ether, amine, amide, imine, sulfoxide, carboxyl, nitrosyl, pyridine, and thioether. Solubility of the metal carbene catalysts can be controlled with selection of either hydrophobic or hydrophilic ligands. Catalysts may exhibit stability in the presence of a variety of functional groups and various solvents, and many therefore be useful in catalyzing reactions that are carried out in aqueous, protic, or organic solvents, or mixtures thereof.

Examples of Ru carbene catalysts include, but are not limited to, Cp*RuCl(PPh$_3$)$_2$ or [Cp*RuCl]$_4$ (Rasmussen et al. (2007), Org. Lett. 9:5337-5339; Zhang et al. (2005), J. Am. Chem. Soc. 127:15998-15999). Other examples include catalysts of the general formula:

wherein: M is selected from the group consisting of Os and Ru; R and $R^1$ are independently selected from the group consisting of hydrogen and a functional group; X and $X^1$ are anionic ligands; and L and $L^1$ are neutral electron donors. More specifically, L and $L^1$ may be phosphines of the formula $PR^3R^4R^5$, where $R^3$ is selected from the group consisting of secondary alkyl and cycloalkyl, and $R^4$ and $R^5$ are independently selected from aryl, $C_1$-$C_{10}$ primary alkyl, secondary alkyl and cycloalkyl. N-heterocyclic ligands such as imidazoline and triazoline ligands (e.g. Grubbs' catalyst, 2$^{nd}$ generation) are also suitable. Other examples also include metathesis catalysts sold by Strem Chemicals, Inc. and Zannan Pharma, Ltd.

Specific embodiments of the general formula include, but are not limited to, the following catalysts:

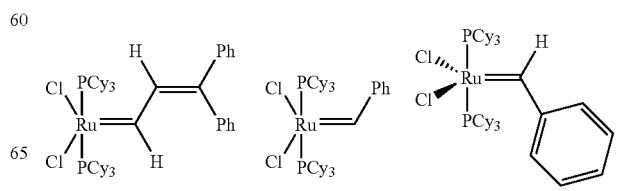

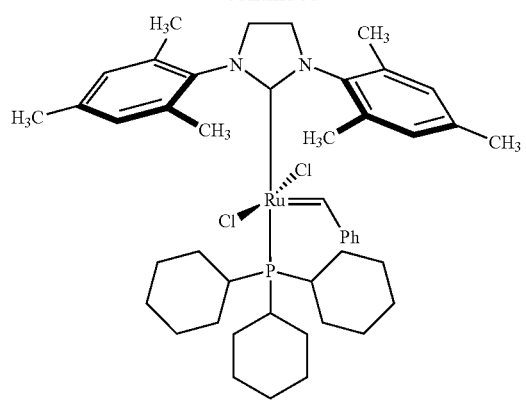
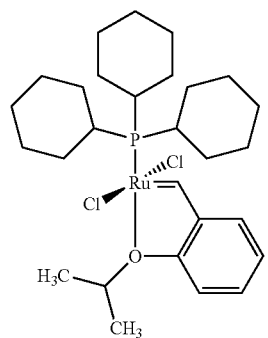
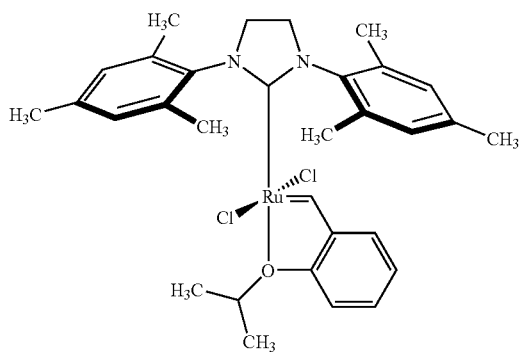
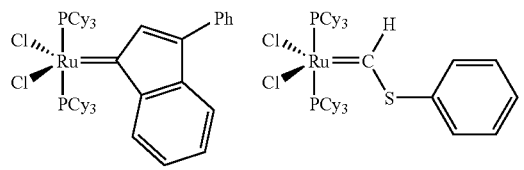
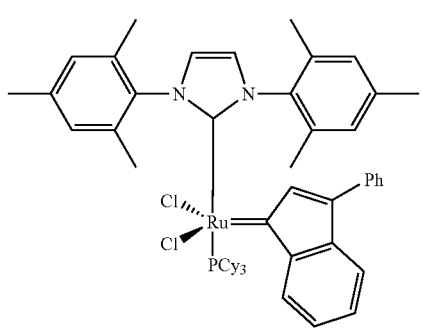
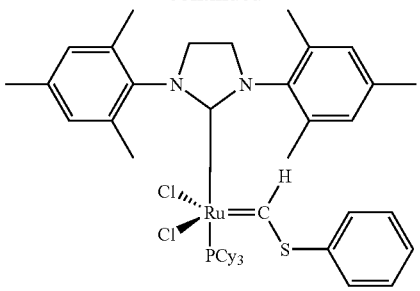
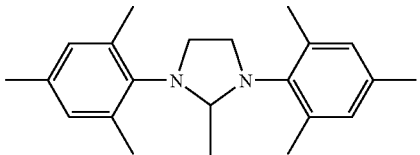
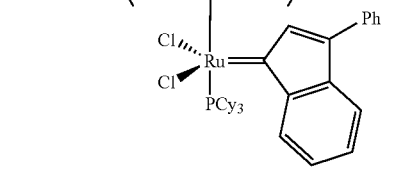
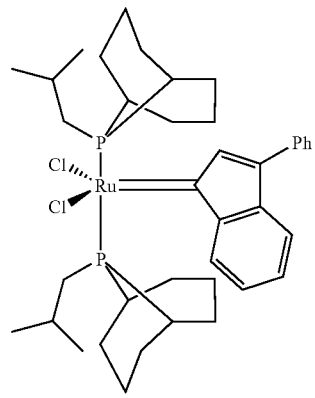
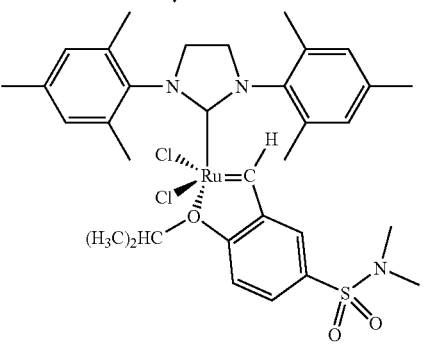
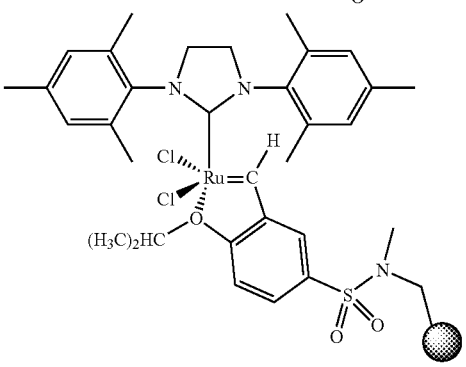

Additional catalysts are described in U.S. Pat. No. 6,407,190; EP 993465, U.S. Pat. No. 6,635,768, CN 1907992A, US Application No. 2007/0043180 A1, incorporated by reference in their entirety.

Metathesis catalysts bound to polymeric or inorganic supports, which allow them to be removed by filtration, have been discussed (see e.g. K. C. Hultzsch, J. A Jernelius, A. H Hoveyda and R. R Schrock, *Angew. Chem., Int. Ed.* 41 (2002), p. 589; M Ahmed, A. G. M Barrett, D. C. Braddock, S. M Cramp and R. A Procopiou, *Tetrahedron Lett.* 40 (1999), pp. 8657-8662; D. P. Allen et al., *Org. Lett.* 11, 1261-1264 (2009); or M. R. Baumeister, *Chem. Rev.* 109, 303-321 (2009) and references therein). Non-limiting examples of this type of catalyst are:

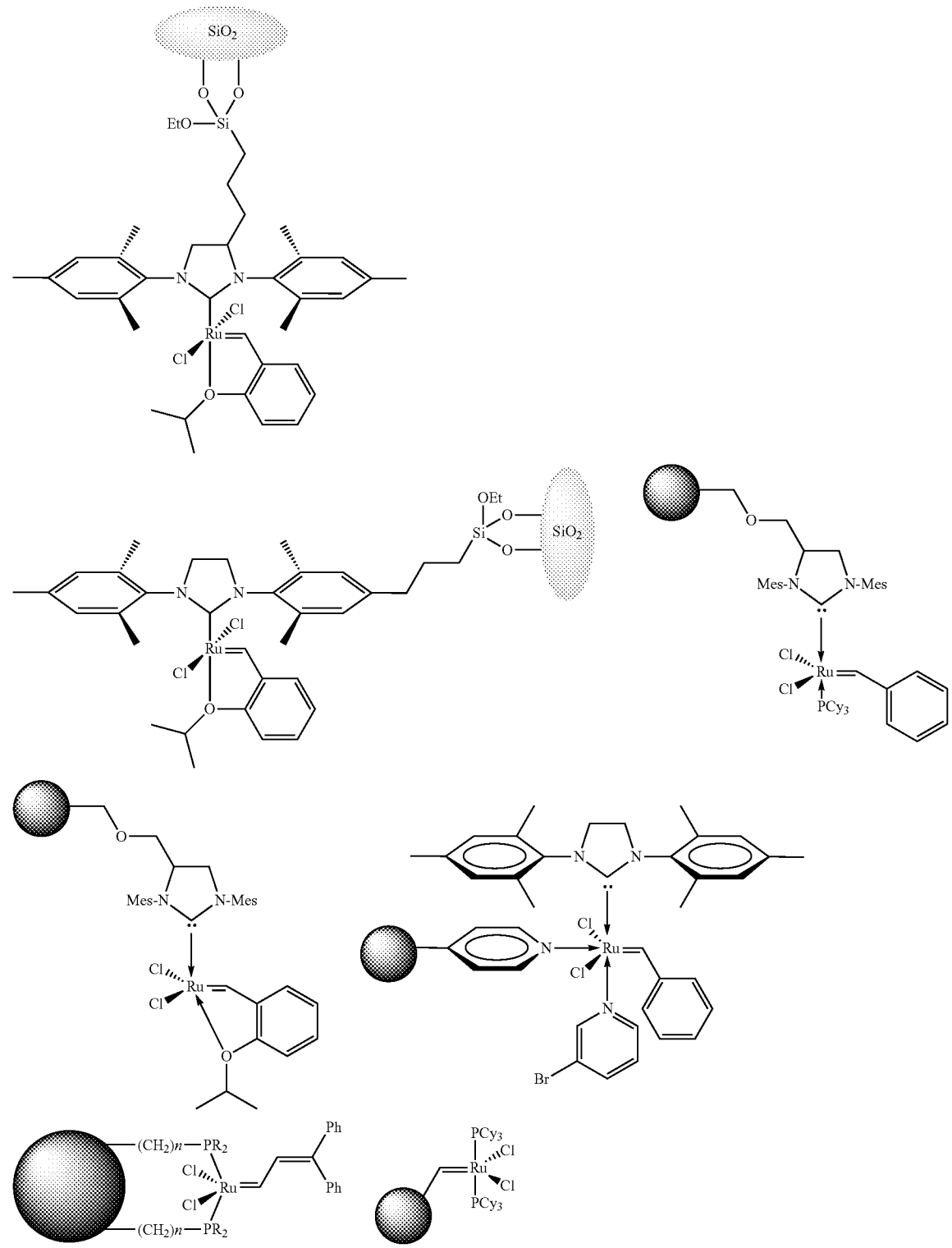

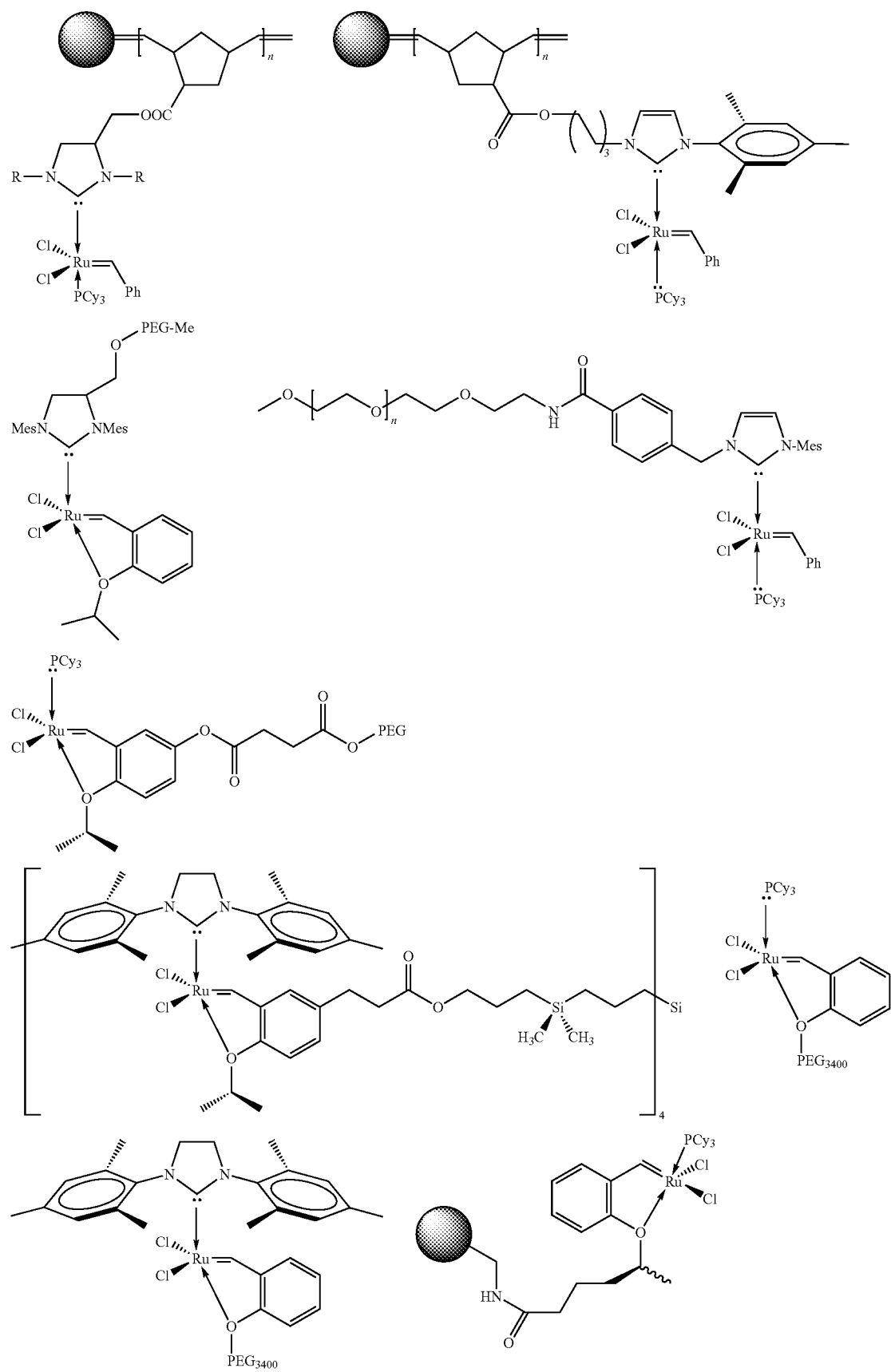
-continued

41
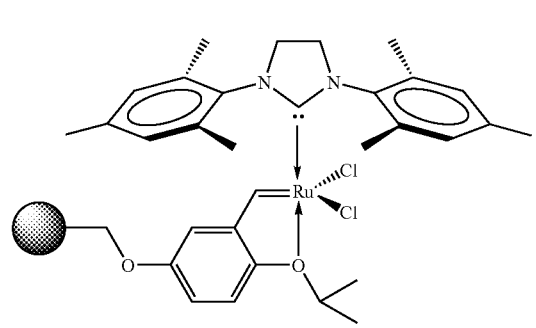
42
-continued
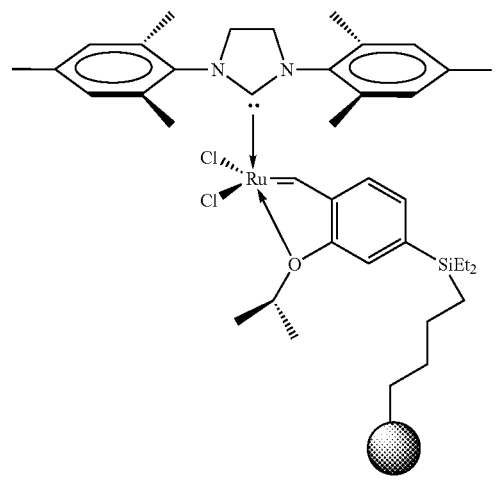
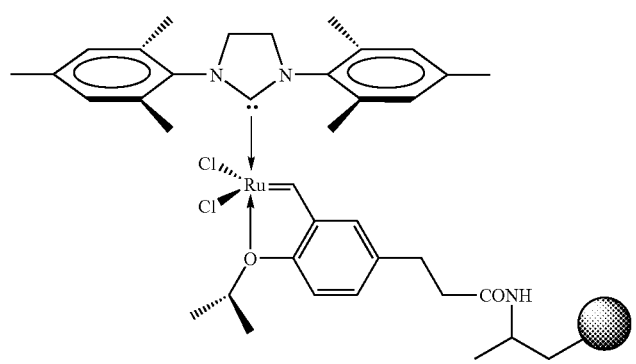
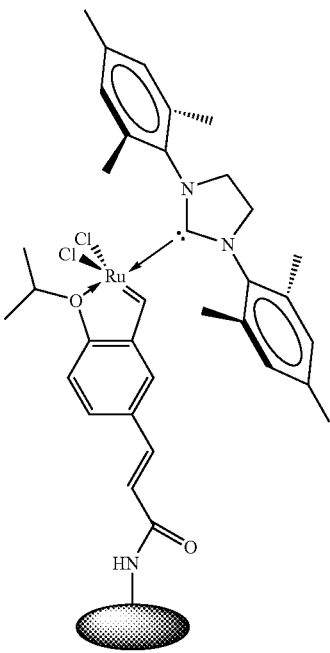
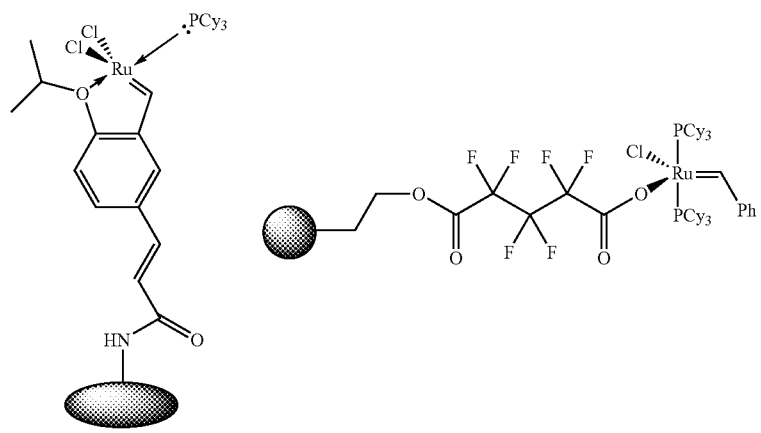

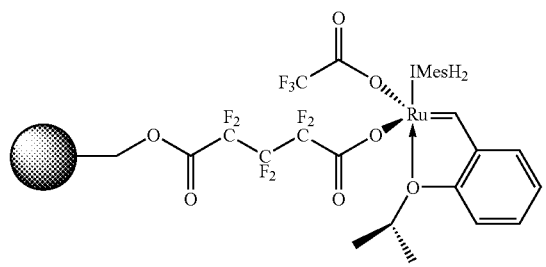
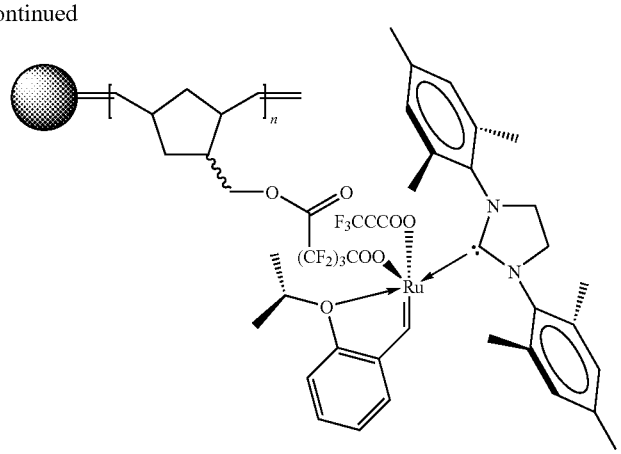
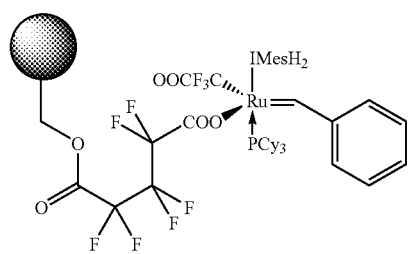
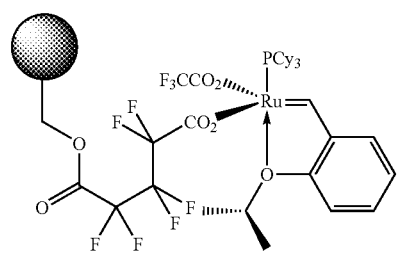
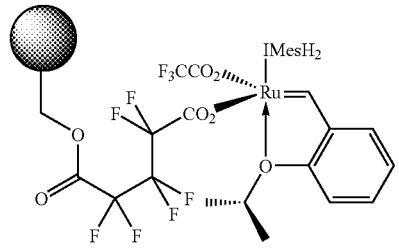
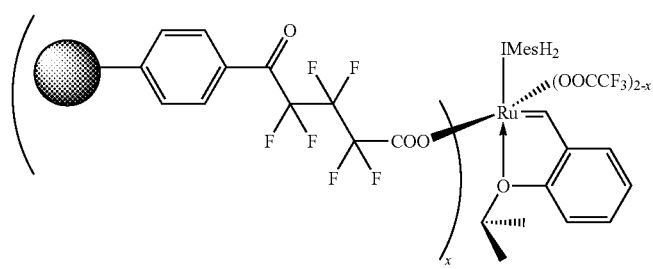
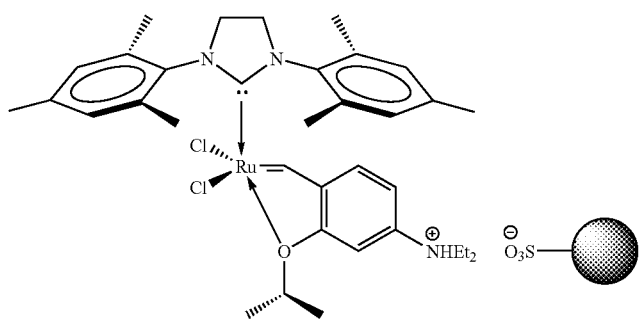

Suitable catalysts may be prepared by a variety of different methods such as those methods described in U.S. Pat. Nos. 5,312,940; 6,921,735; P. Schwab et al., J. Am. Chem. Soc. 118, 100 (1996); D. P. Allen et al., Org. Lett. 11, 1261-1264 (2009); or M. R. Baumeister, Chem. Rev. 109, 303-321 (2009) and references therein, which are incorporated herein by reference.

The metathesis reaction may be performed, for example, at a temperature between about 25° C. and 110° C., or at about 50° C. The metathesis reaction may be performed with an organic solvent, such as dichloromethane, dichloroethane, trichloroethane, toluene, dimethylformamide, acetonitrile, tetrahydrofuran.

The reactions disclosed herein may, for example, be carried out on a solid support. Suitable solid supports include particles, strands, precipitates, gels, sheets, tubing, spheres, containers, capillaries, pads, slices, films, plates, slides, discs, membranes, etc. These solid supports can be made from a wide variety of materials, including polymers, plastics, ceramics, polysaccharides, silica or silica-based materials, carbon, metals, inorganic glasses, membranes, or composites thereof. The substrate is preferably flat but may take on a variety of alternative surface configurations. For example, the substrate may contain raised or depressed regions on which the synthesis takes place. The substrate and its surface preferably form a rigid support on which to carry out the reactions described herein. Other substrate materials may also be used.

Purification of the Peptidomimetic Macrocycles

Generally, the peptidomimetic macrocycles of the invention are purified using a combination of purification steps. In some embodiments of the invention, the peptidomimetic macrocycle precursor is synthesized on a solid-phase support.

Following cyclization, the solid-phase support may be isolated and suspended in a solution of a solvent such as DMSO, DMSO/dichloromethane mixture, or DMSO/NMP mixture. The DMSO/dichloromethane or DMSO/NMP mixture may comprise about 30%, 40%, 50% or 60% DMSO. In a specific embodiment, a 50%/50% DMSO/NMP solution is used. The solution may be incubated for a period of 1, 6, 12 or 24 hours, following which the resin may be washed, for example with dichloromethane or NMP. In one embodiment, the resin is washed with NMP. Shaking and bubbling an inert gas into the solution may be performed.

In some embodiments, this incubation step is followed by a treatment with a scavenger in the presence of a solvent. If the catalyst is attached to a solid phase (e.g. resin, bead), then filtration may be used to recover the catalyst by separating the solid phase from the reaction mixture.

Exemplary scavengers include propylamine, diaminoethane, N1-(2-aminoethyl)ethane-1,2-diamine, trithiocyanuric acid, ethanedithiol, thiophenol, diethylthiourea, triphenylphosphine oxide, or 2-mercaptonicotinic acid. The incubation may be performed at room temperature or at a higher temperature, e.g. 35, 50, or 65° C. The scavenger treatment step may be repeated, for example once, twice, or three times. In some embodiments, the scavenger treatments are separated or followed by additional washing steps with the same or a different solvent.

Other scavengers are available from commercial sources (e.g. Reaxa, Engelhard, Johnson Matthey, Sigma-Aldrich). Non-limiting examples of metal scavengers are Deloxan metal scavengers from Degussa AG such as Deloxan THP II and Deloxan MP. These are macroporous organofunctional polysiloxanes and are capable of removing Pd, Pt, Rh, Ag, Au, Zn, Cu and other transition metals from active pharmaceutical ingredients and chemical processes. Deloxan THP II carries thiourea as functional group while Deloxan MP carries a thiol functionality. These scavengers can be used in batch mode or tubular plug-flow mode. In a batch reactor, the Deloxan metal scavenger is added to the reaction mixture, stirred and filtered off. In tubular plug-flow reactor mode of operation, the Deloxan metal scavenger is put into a fixed-bed column and a filtration step is eliminated.

Metal-specific scavengers employing various functionalities are suitable to purify the peptidomimetic macrocycles. Non-limiting examples of scavengers with functionalities include QuadraPure scavenging resins from Reaxa such as QuadraPure TU, which is a macroporous bead with thiourea functionalities. Other non-limiting scavenging products from Reaxa that may be used include QuadraPure IDA (bead with imino diacetate functionality), AMPA (bead with aminomethyl phosphonic functionality), BZA (bead with benzyl amine functionality), BDZ (bead with imidazole functionalities), EDA (bead with amine functionalities), DET (bead with thiol functionalities), IMDAZ (bead with imidazolylpropyl amino functionality), MPA (bead with mercaptophenyl amino functionality), AEA (bead with aminoethyl amino functionality), AK (bead with activated ketone functionality, e.g. 2,4-butanedione).

Additional metal scavengers include Reaxa compounds manufactured under the trade name QuadraSil, which are based on spherical silica beads with defined porosity and can be used in aqueous or organic solution and in batch or flow processes. Specific examples include QuadraSil AP (beads with amino propyl functionality), MP (beads with mercaptopropyl functionality), MTU (beads with methylthiourea functionality), TA (beads with triamine functionality).

Other metal-scavenging agents, such as supplied by Engelhard, can also be used. These agents are free-flowing powders prepared from inorganic substrates, including silica, alumina, and activated carbon and are capable of scavenging different metals. They are designed for fixed-bed or slurry applications using aqueous and organic solvents. Another example of a scavenger is Smopex® from Johnson Matthey and is a fibrous metal scavenging system. Smopex-111 is a styryl thiol-grafted polyolefin fiber that can remove palladium, platinum, rhodium, and copper. Similarly, Smopex-105 is a vinyl pyridine-grafted polyolefin fiber that can pick up anionic platinum group metals and complexes, and Smopex-102 is an acrylic acid-grafted fiber for cation scavenging of nickel, iron, or chromium. The 0.3-mm-long Smopex fibers are mechanically and chemically very stable. Polymer-bound chelate phosphine such as one discussed in Tetrahedron Letters: 45 (2004), 3141-3142 (which is incorporated herein by reference) are also suitable as a scavenger. Additional scavenger reagents include SiliaBond DMT (dimercaptotriazine), and tris(hydroxymethyl)phosphine.

Following this first washing step, crude peptidomimetic macrocycle is prepared by separating the peptidomimetic macrocycles from the solid support. The crude peptidomimetic macrocycle preparation is then subjected to further purification. Macrocycles, as well as the byproducts resulting from the metathesis reaction, may be recovered or separated using any suitable technique including chromatography (e.g. chromatography, such as reverse-phase HPLC) or filtration. In some embodiments, the peptidomimetic macrocycles are subjected to one, two or three reverse phase HPLC steps. For example, two reverse phase HPLC steps are used. In one embodiment, at least one of said HPLC steps is performed using an acidic solvent, such as dilute TFA (for example, 0.05-0.5%) in $H_2O$ and/or acetonitrile. Alternatively, tetraethylammonium phosphate (TEAP) at acidic pH may be used as the buffer system. In one embodiment, the acidic solvent comprises dilute TFA. In another embodiment, the solvent comprises TEAP. In one embodiment of the method of the invention, two reverse phase HPLC steps are used, in which one step uses dilute TFA as the solvent and the second step uses $H_2O$ and/or acetonitrile with no TFA as the solvent. In another embodiment of the method of the invention, two reverse phase HPLC steps are used, in which both steps use dilute TFA as the solvent. In yet another embodiment, two reverse phase HPLC steps are used, in which one step uses dilute TFA as the solvent, while another step uses TEAP as the solvent. In still another embodiment, at least one reverse phase HPLC purification step is performed using dilute formic acid in $H_2O$ and/or acetonitrile as the solvent.

In another aspect, the invention provides a method of purifying crude peptidomimetic macrocycles that does not require performing a crystallization step to obtain high purity (e.g. less than 30, 20, 10, 5 or 1 ppm Ru or Os content) peptidomimetic macrocycles.

In another aspect, the invention provides methods to measure and evaluate the level of impurities. Non-limiting examples of instruments that can be used in the analysis of impurities include analytical techniques such as nuclear inductively coupled plasma analysis (ICP), nuclear inductively coupled plasma mass spectrometry analysis (ICP-ms), magnetic resonance spectroscopy, infrared spectroscopy, mass spectrometry, gas chromatography and high performance liquid chromatography.

In evaluating impurities, the specificity of the analytical instruments is assessed in several ways. In one embodiment, the level of impurities associated with the inventive composition is assessed by methods conforming to the regulatory guidelines published by the Food and Drug Administration. For example, for a positive test of the equipment used for the evaluation of impurities, a first analyte of known impurities are used in comparison to a second analyte structurally similar to the first analyte with unknown amount of impurities. Similar tests of equipment are also run in the presence of a third agent that potentially interferes with the detection of impurities to gauge the analytical ability of the equipment. Titration can be used to assay for obtaining pharmacokinetic parameters for the drug release in relation to the percentage of impurities to active ingredient. Test of impurities for the effect of expients in terms of the release and activity of the composition is performed to evaluate the impact of impurities on the peptidomimetic macrocycle composition. Other analytical tests include the effect of heat, light, heat, humidity, acid/base hydrolysis, and oxidation on the peptidomimetic macrocycle composition in proportion to the level of impurities.

Another aspect of measuring and evaluating impurities is linearity of the measurement. Several ranges of concentration are used to perform the evaluation of impurities in ranges affordable for mathematical linearity within reasonable limits of error or deviation of data points from the majority of the data points. Mathematical transformation of the data points, such as regression analysis may be applied to confirm linearity of the measurement.

In testing for the effect of impurities on present invention, plus or minus 20 percent of the allowable impurities is subjected to the test. Also, for the concentration ranges of the present invention, compositions comprising 70 percent to 130 percent of the production ranges are subjected to test for impurities.

In quantitating impurities, the level of chemicals originated from the process, the production environment, and the degradation of active ingredient is assessed. In one embodiment, mass spectrometric equipment is used to obtain chemical profile of the test sample. To achieve accuracy and reliability of the data, impurity evaluation may be repeated using a minimum of 9 determinations over a minimum of 3 concentration levels covering the specified range (e.g., 3 concentrations/3 replicates each of the total analytical procedure). Accuracy may be reported as percent recovery by the assay of known added amount of analyte in the sample or as the difference between the mean and the accepted true value together with the confidence intervals. Also to ensure reproducibility, blind-labeled samples may be subjected to inter-laboratory trial. In addition, baseline signal-to-noise level can be measured to a known concentration of active ingredient in comparison to blank samples. Non-limiting examples of other variations that are considered in evaluating impurities include stability of analytical solutions and extraction time. In the case of liquid chromatography, such examples include influence of variations of pH in a mobile phase, influence of variations in mobile phase composition, different columns (different lots and/or suppliers), temperature and flow rate. In the case of gas-chromatography, examples of typical variations are different columns (different lots and/or suppliers), temperature and flow rate.

Assays

The properties of the peptidomimetic macrocycles of the invention are assayed, for example, by using the methods described below. In some embodiments, a peptidomimetic macrocycle of the invention has improved biological properties relative to a corresponding polypeptide lacking the substituents described herein.

Assay to Determine α-Helicity.

In solution, the secondary structure of polypeptides with α-helical domains will reach a dynamic equilibrium between random coil structures and α-helical structures, often expressed as a "percent helicity". Thus, for example, unmodified pro-apoptotic BH3 domains are predominantly random coils in solution, with α-helical content usually under 25%. Peptidomimetic macrocycles with optimized linkers, on the other hand, possess, for example, an alpha-helicity that is at least two-fold greater than that of a corresponding macrocycle lacking the R— substituent. In some embodiments, macrocycles of the invention will possess an alpha-helicity of greater than 50%. To assay the helicity of peptidomimetic macrocycles of the invention, such as BH3 domain-based macrocycles, the compounds are dissolved in an aqueous solution (e.g. 50 mM potassium phosphate solution at pH 7, or distilled $H_2O$, to concentrations of 25-50 μM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222 obs) by the reported value for a model helical decapeptide (Yang et al. (1986), *Methods Enzymol.* 130:208)).

Assay to Determine Melting Temperature (Tm).

A peptidomimetic macrocycle of the invention comprising a secondary structure such as an α-helix exhibits, for example, a higher melting temperature than a corresponding macrocycle lacking the R— substituent. Typically peptidomimetic macrocycles of the invention exhibit Tm of>60° C. representing a highly stable structure in aqueous solutions. To assay the effect of macrocycle formation on meltine temperature, peptidomimetic macrocycles or unmodified peptides are dissolved in distilled $H_2O$ (e.g. at a final concentration of 50 μM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay.

The amide bond of the peptide backbone is susceptible to hydrolysis by proteases, thereby rendering peptidic compounds vulnerable to rapid degradation in vivo. Peptide helix formation, however, typically buries the amide backbone and therefore may shield it from proteolytic cleavage. The peptidomimetic macrocycles of the present invention may be subjected to in vitro trypsin proteolysis to assess for any change in degradation rate compared to a corresponding macrocycle lacking the R— substituent. For example, the peptidomimetic macrocycle and a corresponding macrocycle lacking the R— substituent are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E ~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln[S] versus time (k=−1Xslope).

Ex Vivo Stability Assay.

Peptidomimetic macrocycles with optimized linkers possess, for example, an ex vivo half-life that is at least two-fold greater than that of a corresponding macrocycle lacking the R— substituent, and possess an ex vivo half-life of 12 hours or more. For ex vivo serum stability studies, a variety of assays may be used. For example, a peptidomimetic macrocycle and a corresponding macrocycle lacking the R— substituent (2 mcg) are incubated with fresh mouse, rat and/or human serum (2 mL) at 37° C. for 0, 1, 2, 4, 8, and 24 hours. To determine the level of intact compound, the following procedure may be used: The samples are extracted by transferring 100 µl of sera to 2 ml centrifuge tubes followed by the addition of 10 µL of 50% formic acid and 500 µL acetonitrile and centrifugation at 14,000 RPM for 10 min at 4±2° C. The supernatants are then transferred to fresh 2 ml tubes and evaporated on Turbovap under $N_2$<10 psi, 37° C. The samples are reconstituted in 100 µL of 50:50 acetonitrile:water and submitted to LC-MS/MS analysis.

In Vitro Binding Assays.

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values may be determined by nonlinear regression analysis using, for example, Graphpad Prism software (GraphPad Software, Inc., San Diego, Calif.). A peptidomimetic macrocycle of the invention shows, in some instances, similar or lower Kd than a corresponding macrocycle lacking the R— substituent.

Acceptor proteins for BH3-peptides such as BCL-2, BCL-$X_L$, BAX or MCL1 may, for example, be used in this assay. Acceptor proteins for p53 peptides such as MDM2 or MDMX may also be used in this assay.

In Vitro Displacement Assays to Characterize Antagonists of Peptide-Protein Interactions.

To assess the binding and affinity of compounds that antagonize the interaction between a peptide (e.g. a BH3 peptide or a p53 peptide) and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values may be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay. Acceptor proteins for BH3-peptides such as BCL2, BCL-XL, BAX or MCL1 can be used in this assay. Acceptor proteins for p53 peptides such as MDM2 or MDMX can be used in this assay.

Binding Assays in Intact Cells.

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µl goat anti-FITC antibody for 2 hrs, rotating at 4° C. followed by further 2 hrs incubation at 4° C. with protein A/G Sepharose (50 µl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle, including BCL2, MCL1, BCL-XL, A1, BAX, BAK, MDM2 or MDMX.

Cellular Penetrability Assays.

A peptidomimetic macrocycle is, for example, more cell permeable compared to a corresponding macrocycle lacking the R— substituent. In some embodiments, the peptidomimetic macrocycles are more cell permeable than a corresponding macrocycle lacking the R— substituents. Peptidomimetic macrocycles with optimized linkers possess, for example, cell penetrability that is at least two-fold greater than a corresponding macrocycle lacking the R— substituent, and often 20% or more of the applied peptidomimetic macrocycle will be observed to have penetrated the cell after 4 hours. To measure the cell penetrability of peptidomimetic macrocycles and corresponding macrocycle lacking the R— substituents, intact cells are incubated with fluoresceinated peptidomimetic macrocycles or corresponding macrocycle lacking the R— substituents (10 µM) for 4 hrs in serum free media at 37° C., washed twice with media and incubated with trypsin (0.25%) for 10 min at 37° C. The cells are washed again and resuspended in PBS. Cellular fluorescence is analyzed, for example, by using either a FACSCalibur flow cytometer or Cellomics' KineticScan® HCS Reader.

Cellular Efficacy Assays.

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at EC50<10 µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

In Vivo Stability Assay.

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

In Vivo Efficacy in Animal Models.

To determine the anti-oncogenic activity of peptidomimetic macrocycles of the invention in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5\times10^6$ RS4; 11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, Mass.). Total body bioluminescence is quantified by integration of photonic flux (photons/sec) by Living Image Software (Caliper Life Sciences, Hopkinton, Mass.). Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma, that stably expresses luciferase. These in vivo tests optionally generate preliminary pharmacokinetic, pharmacodynamic and toxicology data.

Clinical Trials.

To determine the suitability of the peptidomimetic macrocycles of the invention for treatment of humans, clinical trials are performed. For example, patients diagnosed with cancer and in need of treatment are selected and separated in treatment and one or more control groups, wherein the treatment group is administered a peptidomimetic macrocycle of the invention, while the control groups receive a placebo or a known anti-cancer drug. The treatment safety and efficacy of the peptidomimetic macrocycles of the invention can thus be evaluated by performing comparisons of the patient groups with respect to factors such as survival and quality-of-life. In this example, the patient group treated with a peptidomimetic macrocycle show improved long-term survival compared to a patient control group treated with a placebo.

Pharmaceutical Compositions and Routes of Administration

The peptidomimetic macrocycles of the invention also include pharmaceutically acceptable derivatives or prodrugs thereof. A "pharmaceutically acceptable derivative" means any pharmaceutically acceptable salt, ester, salt of an ester, pro-drug or other derivative of a compound of this invention which, upon administration to a recipient, is capable of providing (directly or indirectly) a compound of this invention. Particularly favored pharmaceutically acceptable derivatives are those that increase the bioavailability of the compounds of the invention when administered to a mammal (e.g., by increasing absorption into the blood of an orally administered compound) or which increases delivery of the active compound to a biological compartment (e.g., the brain or lymphatic system) relative to the parent species. Some pharmaceutically acceptable derivatives include a chemical group which increases aqueous solubility or active transport across the gastrointestinal mucosa.

In some embodiments, the peptidomimetic macrocycles of the invention are modified by covalently or non-covalently joining appropriate functional groups to enhance selective biological properties. Such modifications include those which increase biological penetration into a given biological compartment (e.g., blood, lymphatic system, central nervous system), increase oral availability, increase solubility to allow administration by injection, alter metabolism, and alter rate of excretion.

Pharmaceutically acceptable salts of the compounds of this invention include those derived from pharmaceutically acceptable inorganic and organic acids and bases. Examples of suitable acid salts include acetate, adipate, benzoate, benzenesulfonate, butyrate, citrate, digluconate, dodecylsulfate, formate, fumarate, glycolate, hemisulfate, heptanoate, hexanoate, hydrochloride, hydrobromide, hydroiodide, lactate, maleate, malonate, methanesulfonate, 2-naphthalenesulfonate, nicotinate, nitrate, palmoate, phosphate, picrate, pivalate, propionate, salicylate, succinate, sulfate, tartrate, tosylate and undecanoate. Salts derived from appropriate bases include alkali metal (e.g., sodium), alkaline earth metal (e.g., magnesium), ammonium and N-(alkyl)$_4^+$ salts.

Pharmaceutical compositions of this invention comprise a peptidomimetic macrocycle described herein or a pharmaceutically acceptable salt thereof; an additional agent including for example, morphine or codeine; and any pharmaceutically acceptable carrier, adjuvant or vehicle. Alternate compositions of this invention comprise a peptidomimetic macrocycle described herein or a pharmaceutically acceptable salt thereof; and a pharmaceutically acceptable carrier, adjuvant or vehicle. The compositions delineated herein include the peptidomimetic macrocycle delineated herein, as well as additional therapeutic agents if present, in amounts effective for achieving a modulation of disease or disease symptoms, including BCL-2 family member mediated disorders or symptoms thereof.

The term "pharmaceutically acceptable carrier or adjuvant" refers to a carrier or adjuvant that may be administered to a patient, together with a compound of this invention, and which does not destroy the pharmacological activity thereof and is nontoxic when administered in doses sufficient to deliver a therapeutic amount of the compound.

Pharmaceutically acceptable carriers, adjuvants and vehicles that may be used in the pharmaceutical compositions of this invention include, but are not limited to, ion exchangers, alumina, aluminum stearate, lecithin, self-emulsifying drug delivery systems (SEDDS) such as d-alpha-tocopherol polyethyleneglycol 1000 succinate, surfactants used in pharmaceutical dosage forms such as Tweens or other similar polymeric delivery matrices, serum proteins, such as human serum albumin, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropyle-ne-block polymers, polyethylene glycol and wool fat. Cyclodextrins such as alpha-, beta-, and gamma-cyclodextrin, may also be advantageously used to enhance delivery of compounds of the formulae described herein.

For preparing pharmaceutical compositions from the compounds of the present invention, pharmaceutically acceptable carriers include either solid or liquid carriers. Solid form preparations include powders, tablets, pills, capsules, cachets, suppositories, and dispersible granules. A solid carrier can be one or more substances, which also acts as diluents, flavoring agents, binders, preservatives, tablet disintegrating agents, or an encapsulating material. Details on techniques for formulation and administration are well described in the scientific and patent literature, see, e.g., the latest edition of Remington's Pharmaceutical Sciences, Maack Publishing Co, Easton Pa.

In powders, the carrier is a finely divided solid, which is in a mixture with the finely divided active component. In tablets, the active component is mixed with the carrier having the necessary binding properties in suitable proportions and compacted in the shape and size desired.

Suitable solid excipients are carbohydrate or protein fillers include, but are not limited to sugars, including lactose, sucrose, mannitol, or sorbitol; starch from corn, wheat, rice, potato, or other plants; cellulose such as methyl cellulose, hydroxypropylmethyl-cellulose, or sodium carboxymethyl-cellulose; and gums including arabic and tragacanth; as well as proteins such as gelatin and collagen. If desired, disintegrating or solubilizing agents are added, such as the cross-linked polyvinyl pyrrolidone, agar, alginic acid, or a salt thereof, such as sodium alginate.

Liquid form preparations include solutions, suspensions, and emulsions, for example, water or water/propylene glycol solutions. For parenteral injection, liquid preparations can be formulated in solution in aqueous polyethylene glycol solution.

The peptidomimetic macrocycle described herein can, for example, be administered by injection, intravenously, intraarterially, subdermally, intraperitoneally, intramuscularly, or subcutaneously; or orally, buccally, nasally, transmucosally, topically, in an ophthalmic preparation, or by inhalation, with a dosage ranging from about 0.001 to about 100 mg/kg of body weight, or according to the requirements of the particular drug. The methods herein contemplate administration of an effective amount of compound or compound composition to achieve the desired or stated effect. Typically, the pharmaceutical compositions of this invention will be administered from about 1 to about 6 times per day or alternatively, as a continuous infusion. Such administration can be used as a chronic or acute therapy. The amount of active ingredient that may be combined with the carrier materials to produce a single dosage form will vary depending upon the host treated and the particular mode of administration. A typical preparation will contain from about 5% to about 95% active compound (w/w). Alternatively, such preparations contain from about 20% to about 80% active compound.

Lower or higher doses than those recited above may be required. Specific dosage and treatment regimens for any particular patient will depend upon a variety of factors, including the activity of the specific compound employed, the age, body weight, general health status, sex, diet, time of administration, rate of excretion, drug combination, the severity and course of the disease, condition or symptoms, the patient's disposition to the disease, condition or symptoms, and the judgment of the treating physician.

Upon improvement of a patient's condition, a maintenance dose of a compound, composition or combination of this invention may be administered, if necessary. Subsequently, the dosage or frequency of administration, or both, may be reduced, as a function of the symptoms, to a level at which the improved condition is retained. Patients may, however, require intermittent treatment on a long-term basis upon any recurrence of disease symptoms.

The pharmaceutical compositions of this invention may be administered orally, parenterally, by inhalation spray, topically, rectally, nasally, buccally, vaginally or via an implanted reservoir, preferably by oral administration or administration by injection. The pharmaceutical compositions of this invention may contain any conventional non-toxic pharmaceutically-acceptable carriers, adjuvants or vehicles. In some cases, the pH of the formulation may be adjusted with pharmaceutically acceptable acids, bases or buffers to enhance the stability of the formulated compound or its delivery form. The term parenteral as used herein includes subcutaneous, intracutaneous, intravenous, intramuscular, intraarticular, intraarterial, intrasynovial, intrasternal, intrathecal, intralesional and intracranial injection or infusion techniques.

The pharmaceutical compositions may be in the form of a sterile injectable preparation, for example, as a sterile injectable aqueous or oleaginous suspension. This suspension may be formulated according to techniques known in the art using suitable dispersing or wetting agents (such as, for example, Tween 80) and suspending agents. The sterile injectable preparation may also be a sterile injectable solution or suspension in a non-toxic parenterally acceptable diluent or solvent, for example, as a solution in 1,3-butanediol. Among the acceptable vehicles and solvents that may be employed are mannitol, water, Ringer's solution and isotonic sodium chloride solution. In addition, sterile, fixed oils are conventionally employed as a solvent or suspending medium. For this purpose, any bland fixed oil may be employed including synthetic mono- or diglycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, or carboxymethyl cellulose or similar dispersing agents which are commonly used in the formulation of pharmaceutically acceptable dosage forms such as emulsions and or suspensions. Other commonly used surfactants such as Tweens or Spans and/or other similar emulsifying agents or bioavailability enhancers which are commonly used in the manufacture of pharmaceutically acceptable solid, liquid, or other dosage forms may also be used for the purposes of formulation.

The pharmaceutical compositions of this invention may be orally administered in any orally acceptable dosage form including, but not limited to, capsules, tablets, emulsions and aqueous suspensions, dispersions and solutions. In the case of tablets for oral use, carriers which are commonly used include lactose and corn starch. Lubricating agents, such as magnesium stearate, are also typically added. For oral administration in a capsule form, useful diluents include lactose and dried corn starch. When aqueous suspensions and/or emulsions are administered orally, the active ingredient may be suspended or dissolved in an oily phase is combined with emulsifying and/or suspending agents. If desired, certain sweetening and/or flavoring and/or coloring agents may be added.

The pharmaceutical compositions of this invention may also be administered in the form of suppositories for rectal administration. These compositions can be prepared by mixing a compound of this invention with a suitable non-irritating excipient which is solid at room temperature but liquid at the rectal temperature and therefore will melt in the rectum to release the active components. Such materials include, but are not limited to, cocoa butter, beeswax and polyethylene glycols.

The pharmaceutical compositions of this invention may be administered by nasal aerosol or inhalation. Such compositions are prepared according to techniques well-known in the art of pharmaceutical formulation and may be prepared as solutions in saline, employing benzyl alcohol or other suitable preservatives, absorption promoters to enhance bioavailability, fluorocarbons, and/or other solubilizing or dispersing agents known in the art.

The pharmaceutical preparation is preferably in unit dosage form. In such form the preparation is subdivided into unit doses containing appropriate quantities of the active component. The unit dosage form can be a packaged preparation, the package containing discrete quantities of preparation, such as packeted tablets, capsules, and powders in vials or ampoules. Also, the unit dosage form can be a capsule, tablet, cachet, or lozenge itself, or it can be the appropriate number of any of these in packaged form.

When the compositions of this invention comprise a combination of a compound of the formulae described herein and one or more additional therapeutic or prophylactic agents, both the compound and the additional agent should be present at dosage levels of between about 1 to 100%, and more preferably between about 5 to 95% of the dosage normally administered in a monotherapy regimen. The additional agents may be administered separately, as part of a multiple dose regimen, from the compounds of this invention. Alternatively, those agents may be part of a single dosage form, mixed together with the compounds of this invention in a single composition.

Methods of Use

In one aspect, the present invention provides novel peptidomimetic macrocycles that are useful in competitive binding assays to identify agents which bind to the natural ligand(s) of the proteins or peptides upon which the peptidomimetic macrocycles are modeled. For example, in the p53 MDM2 system, labeled stabilized peptidomimetic macrocycles based on the p53 is used in an MDM2 binding assay along with small molecules that competitively bind to MDM2. Competitive binding studies allow for rapid in vitro evaluation and determination of drug candidates specific for the p53/MDM2 system. Likewise in the BH3/BCL-$X_L$ anti-apoptotic system labeled peptidomimetic macrocycles based on BH3 can be used in a BCL-$X_L$ binding assay along with small molecules that competitively bind to BCL-$X_L$. Competitive binding studies allow for rapid in vitro evaluation and determination of drug candidates specific for the BH3/BCL-$X_L$ system. The invention further provides for the generation of antibodies against the peptidomimetic macrocycles. In some embodiments, these antibodies specifically bind both the peptidomimetic macrocycle and the p53 or BH3 peptidomimetic precursors upon which the peptidomimetic macrocycles are derived. Such antibodies, for example, disrupt the p53/MDM2 or BH3/BCL-XL systems, respectively.

In other aspects, the present invention provides for both prophylactic and therapeutic methods of treating a subject at risk of (or susceptible to) a disorder or having a disorder associated with aberrant (e.g., insufficient or excessive) BCL-2 family member expression or activity (e.g., extrinsic or intrinsic apoptotic pathway abnormalities). It is believed that some BCL-2 type disorders are caused, at least in part, by an abnormal level of one or more BCL-2 family members (e.g., over or under expression), or by the presence of one or more BCL-2 family members exhibiting abnormal activity. As such, the reduction in the level and/or activity of the BCL-2 family member or the enhancement of the level and/or activity of the BCL-2 family member, is used, for example, to ameliorate or reduce the adverse symptoms of the disorder.

In another aspect, the present invention provides methods for treating or preventing hyperproliferative disease by interfering with the interaction or binding between p53 and MDM2 in tumor cells. These methods comprise administering an effective amount of a compound of the invention to a warm blooded animal, including a human, or to tumor cells containing wild type p53. In some embodiments, the administration of the compounds of the present invention induce cell growth arrest or apoptosis. In other or further embodiments, the present invention is used to treat disease and/or tumor cells comprising elevated MDM2 levels. Elevated levels of MDM2 as used herein refers to MDM2 levels greater than those found in cells containing more than the normal copy number (2) of mdm2 or above about 10,000 molecules of MDM2 per cell as measured by ELISA and similar assays (Picksley et al. (1994), *Oncogene* 9, 2523 2529).

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

In some embodiments, the peptidomimetics macrocycles of the invention is used to treat, prevent, and/or diagnose cancers and neoplastic conditions. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states may be categorized as pathologic, i.e., characterizing or constituting a disease state, or may be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. A metastatic tumor can arise from a multitude of primary tumor types, including but not limited to those of breast, lung, liver, colon and ovarian origin. "Pathologic hyperproliferative" cells occur in disease states characterized by malignant tumor growth. Examples of non-pathologic hyperproliferative cells include proliferation of cells associated with wound repair. Examples of cellular proliferative and/or differentiative disorders include cancer, e.g., carcinoma, sarcoma, or metastatic disorders. In some embodiments, the peptidomimetics macrocycles are novel therapeutic agents for controlling breast cancer, ovarian cancer, colon cancer, lung cancer, metastasis of such cancers and the like.

Examples of cancers or neoplastic conditions include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

Examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991), *Crit Rev. Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Stemberg disease.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors.

Examples of cellular proliferative and/or differentiative disorders of the ovary include, but are not limited to, ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

In other or further embodiments, the peptidomimetics macrocycles described herein are used to treat, prevent or diagnose conditions characterized by overactive cell death or cellular death due to physiologic insult, etc. Some examples of conditions characterized by premature or unwanted cell death are or alternatively unwanted or excessive cellular proliferation include, but are not limited to hypocellular/hypoplastic, acellular/aplastic, or hypercellular/hyperplastic conditions. Some examples include hematologic disorders including but not limited to fanconi anemia, aplastic anemia, thalaessemia, congenital neutropenia, myelodysplasia In other or further embodiments, the peptidomimetics macrocycles of the invention that act to decrease apoptosis are used to treat disorders associated with an undesirable level of cell death. Thus, in some embodiments, the anti-apoptotic peptidomimetics macrocycles of the invention are used to treat disorders such as those that lead to cell death associated with viral infection, e.g., infection associated with infection with human immunodeficiency virus (HIV). A wide variety of neurological diseases are characterized by the gradual loss of specific sets of neurons, and the anti-apoptotic peptidomimetics macrocycles of the invention are used, in some embodiments, in the treatment of these disorders. Such disorders include Alzheimer's disease, Parkinson's disease, amyotrophic lateral sclerosis (ALS) retinitis pigmentosa, spinal muscular atrophy, and various forms of cerebellar degeneration. The cell loss in these diseases does not induce an inflammatory response, and apoptosis appears to be the mechanism of cell death. In addition, a number of hematologic diseases are associated with a decreased production of blood cells. These disorders include anemia associated with chronic disease, aplastic anemia, chronic neutropenia, and the myelodysplastic syndromes. Disorders of blood cell production, such as myelodysplastic syndrome and some forms of aplastic anemia, are associated with increased apoptotic cell death within the bone marrow. These disorders could result from the activation of genes that promote apoptosis, acquired deficiencies in stromal cells or hematopoietic survival factors, or the direct effects of toxins and mediators of immune responses. Two common disorders associated with cell death are myocardial infarctions and stroke. In both disorders, cells within the central area of ischemia, which is produced in the event of acute loss of blood flow, appear to die rapidly as a result of necrosis. However, outside the central ischemic zone, cells die over a more protracted time period and morphologically appear to die by apoptosis. In other or further embodiments, the anti-apoptotic peptidomimetics macrocycles of the invention are used to treat all such disorders associated with undesirable cell death.

Some examples of immunologic disorders that are treated with the peptidomimetics macrocycles described herein include but are not limited to organ transplant rejection, arthritis, lupus, IBD, Crohn's disease, asthma, multiple sclerosis, diabetes, etc.

Some examples of neurologic disorders that are treated with the peptidomimetics macrocycles described herein include but are not limited to Alzheimer's Disease, Down's Syndrome, Dutch Type Hereditary Cerebral Hemorrhage Amyloidosis, Reactive Amyloidosis, Familial Amyloid Nephropathy with Urticaria and Deafness, Muckle-Wells Syndrome, Idiopathic Myeloma; Macroglobulinemia-Associated Myeloma, Familial Amyloid Polyneuropathy, Familial Amyloid Cardiomyopathy, Isolated Cardiac Amyloid, Systemic Senile Amyloidosis, Adult Onset Diabetes, Insulinoma, Isolated Atrial Amyloid, Medullary Carcinoma of the Thyroid, Familial Amyloidosis, Hereditary Cerebral Hemorrhage With Amyloidosis, Familial Amyloidotic Polyneuropathy, Scrapie, Creutzfeldt-Jacob Disease, Gerstmann Straussler-Scheinker Syndrome, Bovine Spongiform Encephalitis, a prion-mediated disease, and Huntington's Disease.

Some examples of endocrinologic disorders that are treated with the peptidomimetics macrocycles described herein include but are not limited to diabetes, hypothyroidism, hypopituitarism, hypoparathyroidism, hypogonadism, etc.

Examples of cardiovascular disorders (e.g., inflammatory disorders) that are treated or prevented with the peptidomimetics macrocycles of the invention include, but are not limited to, atherosclerosis, myocardial infarction, stroke, thrombosis, aneurism, heart failure, ischemic heart disease, angina pectoris, sudden cardiac death, hypertensive heart disease; non-coronary vessel disease, such as arteriolosclerosis, small vessel disease, nephropathy, hypertriglyceridemia, hypercholesterolemia, hyperlipidemia, xanthomatosis, asthma, hypertension, emphysema and chronic pulmonary disease; or a cardiovascular condition associated with interventional procedures ("procedural vascular trauma"), such as restenosis following angioplasty, placement of a shunt, stent, synthetic or natural excision grafts, indwelling catheter, valve or other implantable devices. Preferred cardiovascular disorders include atherosclerosis, myocardial infarction, aneurism, and stroke.

EXAMPLES

Example 1

Synthesis of Peptidomimetic Macrocycles

Peptidomimetic macrocycles were prepared on solid support as described in Walensky et al. 2004), Science 305:1466; and Walensky et al., U.S. Patent Publication No. 2005/0250680. The procedure is further illustrated as follows.

| Compound | Sequence | Calculated m/z (M + H) | Calculated m/z (M + 2H)/2 | Calculated m/z (M + 3H)/3 | Found m/z |
|---|---|---|---|---|---|
| 1 | Ac-IWIAQELR$IGD$FNAYYARR-NH2 | 2646.43 | 882.82 | 882.82 | 883.15 (M + 3H)/3 |
| 2 | Ac-RWIAQALR$IGD$FNAFYARR-NH2 | 2615.45 | 872.49 | 872.49 | 872.64 (M + 3H)/3 |
| 3 | Ac-ASQQTF$r8NLWRLL$QN-NH2 | 2052.13 | 1026.62 | 684.72 | 1026.84 (M + 2H)/2 |
| 4 | Pr-RNIARHLA$VAibD$NleDRSI-NH2 | 2139.25 | 1070.13 | 713.76 | 713.79 (M + 3H)/3 |
| 5 | Ac-RWIAQALR$IGN$FNAYYARR-NH2 | 2630.45 | 1315.73 | 877.48 | 877.36 (M + 3H)/3 |
| 6 | Ac-IWIAQALR$IGN$FNAYYARR-NH2 | 2587.43 | 1294.22 | 863.14 | 863.00 (M + 3H)/3 |

(Table discloses SEQ ID NOS 95-100, respectively, in order of appearance)

General Procedure for the Synthesis of Linear Peptides: Commercially available Fmoc-amino acids used for the synthesis were used (Creosalus, Advanced Chemtech, EMD Biosciences) and were protected orthogonally as: Fmoc-Arg(Pbf)-OH, Fmoc-Tyr(t-Bu)-OH, Fmoc-Asn(Trt)-OH, Fmoc-Asp(t-Bu)-OH, Fmoc-Gln(Trt)-OH, Fmoc-Trp(Boc)-OH. HCTU (2-(6-Chloro-1H-benzotriazole-1-yl)-1,1,3,3-tetramethylaminium hexafluorophosphate) was used as the primary coupling reagent for all natural amino acids and HATU (2-(7-Aza-1H-benzotriazole-1-yl)-1,1,3,3-tetramethyluronium hexafluorophosphate) was used for α,α-disubstituted amino acids. Synthesis of the linear peptides was performed using solid phase peptide chemistry on Rink Amide AM resin (EMD biosciences) with a loading of 0.65 mmol/g. Removal of the Fmoc protecting group was accomplished using 25% piperidine in NMP. Coupling of amino acids were performed using 5 equivalents of amino acid, 5 equivalents of HCTU, and 10 equivalents of diisopropylethylamine in NMP with respect to the resin. α,α-Disubstituted amino acids were coupled using HATU or HCTU in a ratio of 2.5:2.5:5 amino acid-HATU or HCTU-DIPEA in NMP with respect to the loading on the resin. Typical coupling times were 1 h. Final N-terminal acylation was accomplished with 5 equivalents of acetic anhydride and 10 equivalents of diisopropylethyl amine.

In the above sequences, the following nomenclature is used:

| | |
|---|---|
| $ | Alpha-Me S5 olefin amino acid |
| $r8 | Alpha-Me R8 olefin amino acid |

General Procedure for Metathesis of Linear Peptides: A solution containing Bis(tricyclohexylphosphine)benzylidine ruthenium (IV) dichloride (Grubbs catalyst) in dichloromethane at a concentration of 4 mg/mL with a total volume to equal 15 mol % with respect to the loading on the resin. After 4 h the resin was filtered and washed with dichloromethane. The metathesis was repeated as necessary to achieve >95% metathesis as analyzed by HPLC.

Example 2

Purification of Peptidomimetic Macrocycles

General Procedure for Scavenging of Ruthenium from resin-bound helical peptides: To a suspension containing helical metathesized peptide on resin swollen in NMP was added DMSO to give a 1:1 NMP-DMSO mixture. The resulting mixture was shaken for 16 h and was filtered and washed with three portions of NMP, three portions of dichloromethane and three portions diethyl ether and dried under diminished pressure.

General Procedure for the cleavage of Peptides from Resin: The resin was treated with a solution containing 90:5:5 trifluoroacetic acid-water-triisopropylsilane. After 4 h, the resin was filtered and the resulting solution was poured into cold (−78° C.) diethyl ether. The resulting solid was collected, dissolved in 1:1 acetonitrile-water, frozen and lyophilized.

General Purification Procedure for Cleaved Peptides: Method A. The lyophilized crude peptide was dissolved in 3:1 DMSO-acetonitrile to a final concentration of 0.1 M and passed through 0.45 μm nylon syringe filter. The compound was purified in 1 mmol batches by reverse phase HPLC using a Varian Pursuit XRs C18 (250 mm×50 mm, 10 μm) column at room temperature. HPLC mobile phases of 0.1% trifluoroacetic acid in $H_2O$ and 0.1% trifluoroacetic acid in acetonitrile are used, flowing at a rate of 50 mL/min. An elution gradient of 45-65% B over 80 minutes was used. Method B. The lyophilized crude peptide was dissolved in 3:1 DMSO-acetonitrile to a final concentration of 0.1 M and passed through 0.45 μm nylon syringe filter. The compound was purified in 1 mmol batches by reverse phase HPLC using a Varian Pursuit XRs C18 (250 mm×50 mm, 10 μm) column at room temperature. HPLC mobile phases of 0.1% trifluoroacetic acid in $H_2O$ and 0.1% trifluoroacetic acid in acetonitrile were used, flowing at a rate of 50 mL/min. Acid free purification was performed using a Varian Pursuit XRs C18 (250 mm×50 mm, 10 μm) column at room temperature. HPLC mobile phases A) $H_2O$ and B) acetonitrile were used, flowing at a rate of 50 mL/min. The compound was loaded and held for 10 column volumes isocratic at 95:5 before elution with a gradient slope of 1% per minute. Pure fractions were isolated and combined for final lyophilization. Method C. The crude material was purified using a C8 media 120 Å, 10 μm. In stage 1 of the purification process, TEAP at pH 2.3 was used as the buffer system. In stage 2 of the purification process, 0.1% TFA was used as the buffer system. Product concentration and salt exchange was performed using diluted HCl. Method D. The crude material was purified by HPLC using a Varian Pursuit XRs C18 (250 mm×50 mm, 10 μm) column at room temperature. HPLC mobile phases of 0.1% formic acid in $H_2O$ and 0.1% formic acid in acetonitrile were used, flowing at a rate of 50 mL/min.

| Compound | w/o purification | 1x HPLC | DMSO only | DMSO + 1x HPLC | DMSO + 2x HPLC |
| --- | --- | --- | --- | --- | --- |
| 1 | 802 ppm | ND | 244 ppm | 75 ppm (method A) | 17 ppm (method B) |
| 2 | ND | 446 ppm | 355 ppm | ND | 6.1 ppm (method B) |
| 3 | ND | 138 ppm | ND | ND | 5.2 ppm (method B) |
| 4 | ND | ND | ND | ND | 32 ppm (method C) |
| 5 | ND | ND | ND | ND | 7.1 ppm (method B) |
| 6 | ND | ND | ND | ND | 7.6 ppm (method B) |

"W/O purification" represents analysis without DMSO scavenging or HPLC purification.
"1x HPLC" represents single pass though an HPLC column (method A) w/o DMSO scavenging.
"DMSO only" represents 16 h incubation with 25% DMSO in NMP prior to cleavage.
"DMSO + 1x HPLC" represents single purification (method A) after 16 h DMSO wash, and "DMSO + 2x HPLC" represents two subsequent HPLC purifications after the DMSO wash; method B and method C are described above and noted respectively.
"ND" signifies "not determined".

General Procedure for Scavenging Cleaved Helical Peptides with Silica Based Resin-Bound Scavengers: To a solution containing DMSO-washed peptide in 1:1 water-acetonitrile solution was added 5 eq. of Si-DMT (Silicycle, part # R79030B) resin and shaken for 16 h at 50° C. The resulting mixture was filtered and the resin was washed with 3 mL of a 1:1 water-acetonitrile solution. The resulting solution was frozen and lyophilized to give a white solid.

| Compound | DMSO* | DMSO + Si-DMT |
| --- | --- | --- |
| 2 | 355 ppm | 58 ppm |

"DMSO*" represents 16 h incubation with 25% DMSO in NMP on resin, and "DMSO + Si-DMT" indicates 16 h incubation of peptide with 5 eq of Si-DMT resin @ 50° C. after the DMSO wash.

General Procedure for Scavenging Cleaved Helical Peptides with Polystyrene Based Resin-Bound Scavengers: To a solution containing DMSO-washed peptide and single pass purified (method D), with a starting Ru count of 146 ppm, peptide in DMF was added 5 eq. of PS-TMT (Polymer Labs, part # PL3527) or 5 eq. of PS-thiourea (Polymer Labs, part# PL350B) resin and shaken for 16 h at room temperature. The resulting mixture was filtered and the resin was washed with DMF. The resulting solution was concentrated under diminished pressure, dissolved in 1:1 water-acetonitrile, frozen and lyophilized to give a white solid.

| Compound | PS-TMT | PS-thiourea |
| --- | --- | --- |
| Compund 1 - initial Ru 146 ppm (method D) | 53 ppm | 85 ppm |

"PS-TMT" represents 5 eq PS-TMT resin in DMF 16 h.
"PS-thiourea" indicates 5 eq PS-thiourea in DMF 16 h.

Procedure for the metathesis of protected peptides using resin-bound metathesis catalysts: The synthesis of unstapled peptide was performed on the acid labile Sieber amide resin (EMD biosciences) using Fmoc-synthetic strategies. The resulting resin was treated with a 1% TFA-dichloromethane (10×2 min) and the solution was treated with 10% pyridine in methanol. The resulting solution was concentrated under diminished pressure. Chromatography was performed on flash silica gel using gradient elution of dichloromethane to 9:1 dichloromethane-methanol. Fractions containing desired product were collected and concentrated under diminished pressure. The resulting peptide was dissolved into dichloromethane and treated with 5 mol % of Si-bound metathesis catalyst (Daryl P. Allen, Matthew M. Van Wingerden and Robert H. Grubbs *Org. Lett,* 2009, 11 (6), pp 1261-1264).

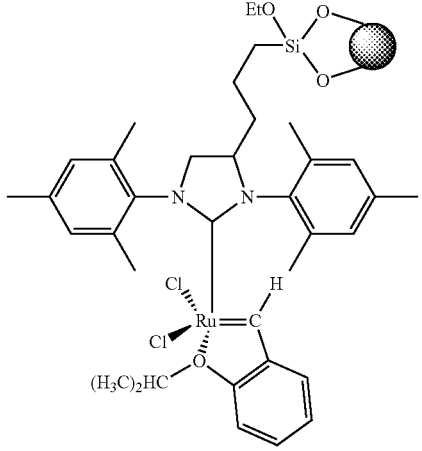

The resulting mixture was shaken for 16 h. The mixture was filtered and the silica-bound catalyst was washed with dichloromethane. The resulting solution was concentrated under diminished pressure. The resulting product was treated with 20 mL of a 90:5:5 trifluoroacetic acid-water-triisopropylsilane solution. After 4 h, the resin was filtered and the resulting solution was poured into 250 mL of cold (−78° C.) diethyl ether.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (119 sequences)

SEQ ID NO: 1 - protein, 21 aa, Homo sapiens
  misc_feature (1)..(1): N-term acetylated
  MOD_RES (9)..(9): Any amino acid available for cross-linking
  misc_feature (9)..(13): Crosslink between residues
  MOD_RES (13)..(13): Any amino acid available for cross-linking
  misc_feature (21)..(21): C-term amidated
IWIAQELRXIGDXFNAYYARR

SEQ ID NO: 2 - protein, 21 aa, Homo sapiens
  misc_feature (1)..(1): N-term acetylated
  MOD_RES (9)..(9): Any amino acid available for cross-linking
  misc_feature (9)..(13): Crosslink between residues
  MOD_RES (13)..(13): Any amino acid available for cross-linking
  misc_feature (21)..(21): C-term amidated
RWIAQALRXIGDXFNAFYARR

SEQ ID NO: 3 - protein, 16 aa, Homo sapiens
  misc_feature (1)..(1): N-term acetylated
  MOD_RES (7)..(7): Any amino acid available for cross-linking
  misc_feature (7)..(14): Crosslink between residues
  MOD_RES (14)..(14): Any amino acid available for cross-linking
  misc_feature (16)..(16): C-term amidated
ASQQTFXNLWRLLXQN

SEQ ID NO: 4 - protein, 18 aa, Homo sapiens
  misc_feature (1)..(1): N-term acetylated
  MOD_RES (9)..(9): Any amino acid available for cross-linking
  misc_feature (9)..(13): Crosslink between residues
  MOD_RES (11)..(11): Methyl-alanine
  MOD_RES (13)..(13): Any amino acid available for cross-linking
  MOD_RES (14)..(14): Nle
  misc_feature (18)..(18): C-term amidated
RNIARHLAXVADXLDRSI

SEQ ID NO: 5 - protein, 21 aa, Homo sapiens
  misc_feature (1)..(1): N-term acetylated
  MOD_RES (9)..(9): Any amino acid available for cross-linking
  misc_feature (9)..(13): Crosslink between residues
  MOD_RES (13)..(13): Any amino acid available for cross-linking
  misc_feature (21)..(21): C-term amidated
RWIAQALRXIGNXFNAYYARR

SEQ ID NO: 6 - protein, 21 aa, Homo sapiens
  misc_feature (1)..(1): N-term acetylated
  MOD_RES (9)..(9): Any amino acid available for cross-linking
  misc_feature (9)..(13): Crosslink between residues
  MOD_RES (13)..(13): Any amino acid available for cross-linking
  misc_feature (21)..(21): C-term amidated
IWIAQALRXIGNXFNAYYARR

SEQ ID NO: 7 - protein, 19 aa, Homo sapiens
PLSQETFSDLWKLLPENNV

SEQ ID NO: 8 - protein, 25 aa, Homo sapiens
QEDIIRNIARHLAQVGDSMDRSIPP

SEQ ID NO: 9 - protein, 25 aa, Homo sapiens
DNRPEIWIAQELRRIGDEFNAYYAR

SEQ ID NO: 10 - protein, 25 aa, Homo sapiens
NLWAAQRYGRELRRMSDEFVDSFKK

SEQ ID NO: 11 - protein, 25 aa, Homo sapiens
EEQWAREIGAQLRRMADDLNAQYER

SEQ ID NO: 12 - protein, 24 aa, Homo sapiens
RSSAAQLTAARLKALGDELHQRTM

SEQ ID NO: 13 - protein, 22 aa, Homo sapiens
AELPPEFAAQLRKIGDKVYCTW

SEQ ID NO: 14 - protein, 25 aa, Homo sapiens
VPADLKDECAQLRRIGDKVNLRQKL

SEQ ID NO: 15 - protein, 24 aa, Homo sapiens
QHRAEVQIARKLQCIADQFHRLHT

SEQ ID NO: 16 - protein, 22 aa, Homo sapiens
SSAAQLTAARLKALGDELHQRT

SEQ ID NO: 17 - protein, 25 aa, Homo sapiens
CMEGSDALALRLACIGDEMDVSLRA

SEQ ID NO: 18 - protein, 24 aa, Homo sapiens
DIERRKEVESILKKNSDWIWDWSS

SEQ ID NO: 19 - protein, 22 aa, Homo sapiens
GRLAEVCAVLLRLGDELEMIRP

SEQ ID NO: 20 - protein, 25 aa, Homo sapiens
PQDASTKKSECLKRIGDELDSNMEL

SEQ ID NO: 21 - protein, 22 aa, Homo sapiens
PSSTMGQVGRQLAIIGDDINRR

SEQ ID NO: 22 - protein, 14 aa, Homo sapiens
KQALREAGDEFELR

SEQ ID NO: 23 - protein, 22 aa, Homo sapiens
LSPPVVHLALALRQAGDDFSRR

SEQ ID NO: 24 - protein, 23 aa, Homo sapiens
EVIPMAAVKQALREAGDEFELRY

SEQ ID NO: 25 - protein, 20 aa, Homo sapiens
PADPLHQAMRAAGDEFETRF

SEQ ID NO: 26 - protein, 23 aa, Homo sapiens
ATSRKLETLRRVGDGVQRNHETA

SEQ ID NO: 27 - protein, 19 aa, Homo sapiens
LAEVCTVLLRLGDELEQIR

SEQ ID NO: 28 - protein, 19 aa, Homo sapiens
MTVGELSRALGHENGSLDP

SEQ ID NO: 29 - protein, 22 aa, Homo sapiens
VVEGEKEVEALKKSADWVSDWS

SEQ ID NO: 30 - protein, 20 aa, Homo sapiens
SMARDPQRYLVIQGDDRMKL

SEQ ID NO: 31 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
QEDIIRNIARHLAXVGDXMDRSIPP

SEQ ID NO: 32 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
DNRPEIWIAQELRXIGDXFNAYYAR

SEQ ID NO: 33 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
NLWAAQRYGRELRXMSDXFVDSFKK

SEQ ID NO: 34 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
EEQWAREIGAQLRXMADXLNAQYER

SEQ ID NO: 35 - protein, 24 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
RSSAAQLTAARLKXLGDXLHQRTM

SEQ ID NO: 36 - protein, 22 aa, Homo sapiens
  MOD_RES (13)..(13): Any amino acid available for cross-linking
  misc_feature (13)..(17): Crosslink between residues
  MOD_RES (17)..(17): Any amino acid available for cross-linking
AELPPEFAAQLRXIGDXVYCTW

SEQ ID NO: 37 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
VPADLKDECAQLRXIGDXVNLRQKL

SEQ ID NO: 38 - protein, 24 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
QHRAEVQIARKLQXIADXFHRLHT

SEQ ID NO: 39 - protein, 22 aa, Homo sapiens
  MOD_RES (13)..(13): Any amino acid available for cross-linking
  misc_feature (13)..(17): Crosslink between residues
  MOD_RES (17)..(17): Any amino acid available for cross-linking
SSAAQLTAARLKXLGDXLHQRT

SEQ ID NO: 40 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
CMEGSDALALRLAXIGDXMDVSLRA

SEQ ID NO: 41 - protein, 24 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
DIERRKEVESILKXNSDXIWDWSS

SEQ ID NO: 42 - protein, 22 aa, Homo sapiens
  MOD_RES (12)..(12): Any amino acid available for cross-linking
  misc_feature (12)..(16): Crosslink between residues
  MOD_RES (16)..(16): Any amino acid available for cross-linking
GRLAEVCAVLLXLGDXLEMIRP

SEQ ID NO: 43 - protein, 25 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
PQDASTKKSECLKXIGDXLDSNMEL

SEQ ID NO: 44 - protein, 22 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
PSSTMGQVGRQLAXIGDXINRR

SEQ ID NO: 45 - protein, 14 aa, Homo sapiens
  MOD_RES (6)..(6): Any amino acid available for cross-linking
  misc_feature (6)..(10): Crosslink between residues
  MOD_RES (10)..(10): Any amino acid available for cross-linking
KQALRXAGDXFELR

SEQ ID NO: 46 - protein, 22 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
LSPPVVHLALALRXAGDXFSRR

SEQ ID NO: 47 - protein, 23 aa, Homo sapiens
  MOD_RES (14)..(14): Any amino acid available for cross-linking
  misc_feature (14)..(18): Crosslink between residues
  MOD_RES (18)..(18): Any amino acid available for cross-linking
EVIPMAAVKQALRXAGDXFELRY

SEQ ID NO: 48 - protein, 20 aa, Homo sapiens
  MOD_RES (11)..(11): Any amino acid available for cross-linking
  misc_feature (11)..(15): Crosslink between residues
  MOD_RES (15)..(15): Any amino acid available for cross-linking
PADPLHQAMRXAGDXFETRF

SEQ ID NO: 49 - protein, 23 aa, Homo sapiens
  MOD_RES (11)..(11): Any amino acid available for cross-linking
  misc_feature (11)..(15): Crosslink between residues
  MOD_RES (15)..(15): Any amino acid available for cross-linking
ATSRKLETLRXVGDXVQRNHETA

SEQ ID NO: 50 - protein, 19 aa, Homo sapiens
  MOD_RES (10)..(10): Any amino acid available for cross-linking
  misc_feature (10)..(14): Crosslink between residues
  MOD_RES (14)..(14): Any amino acid available for cross-linking
LAEVCTVLLXLGDXLEQIR

SEQ ID NO: 51 - protein, 19 aa, Homo sapiens
  MOD_RES (12)..(12): Any amino acid available for cross-linking
  misc_feature (12)..(16): Crosslink between residues
  MOD_RES (16)..(16): Any amino acid available for cross-linking
MTVGELSRALGXENGXLDP

SEQ ID NO: 52 - protein, 22 aa, Homo sapiens
  MOD_RES (13)..(13): Any amino acid available for cross-linking
  misc_feature (13)..(17): Crosslink between residues
  MOD_RES (17)..(17): Any amino acid available for cross-linking
VVEGEKEVEALKXSADXVSDWS

SEQ ID NO: 53 - protein, 20 aa, Homo sapiens
  MOD_RES (12)..(12): Any amino acid available for cross-linking
  misc_feature (12)..(16): Crosslink between residues
  MOD_RES (16)..(16): Any amino acid available for cross-linking
SMARDPQRYLVXQGDXRMKL

SEQ ID NO: 54 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
QEDIIRNIXRHLXQVGDSMDRSIPP

SEQ ID NO: 55 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
DNRPEIWIXQELXRIGDEFNAYYAR

SEQ ID NO: 56 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
NLWAAQRYXRELXRMSDEFVDSFKK

SEQ ID NO: 57 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
EEQWAREIXAQLXRMADDLNAQYER

SEQ ID NO: 58 - protein, 24 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
RSSAAQLTXARLXALGDELHQRTM

SEQ ID NO: 59 - protein, 22 aa, Homo sapiens
  MOD_RES (8)..(8): Any amino acid available for cross-linking
  misc_feature (8)..(12): Crosslink between residues
  MOD_RES (12)..(12): Any amino acid available for cross-linking
AELPPEFXAQLXKIGDKVYCTW

SEQ ID NO: 60 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
VPADLKDEXAQLXRIGDKVNLRQKL

SEQ ID NO: 61 - protein, 24 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
QHRAEVQIXRKLXCIADQFHRLHT

SEQ ID NO: 62 - protein, 22 aa, Homo sapiens
  MOD_RES (8)..(8): Any amino acid available for cross-linking
  misc_feature (8)..(12): Crosslink between residues
  MOD_RES (12)..(12): Any amino acid available for cross-linking
SSAAQLTXARLXALGDELHQRT

SEQ ID NO: 63 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
CMEGSDALXLRLXCIGDEMDVSLRA

SEQ ID NO: 64 - protein, 24 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
DIERRKEVXSILXKNSDWIWDWSS

SEQ ID NO: 65 - protein, 22 aa, Homo sapiens
  MOD_RES (7)..(7): Any amino acid available for cross-linking
  misc_feature (7)..(11): Crosslink between residues
  MOD_RES (11)..(11): Any amino acid available for cross-linking
GRLAEVXAVLXRLGDELEMIRP

SEQ ID NO: 66 - protein, 25 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
PQDASTKKXECLXRIGDELDSNMEL

SEQ ID NO: 67 - protein, 22 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
PSSTMGQVXRQLXIIGDDINRR

SEQ ID NO: 68 - protein, 14 aa, Homo sapiens
  MOD_RES (1)..(1): Any amino acid available for cross-linking
  misc_feature (1)..(5): Crosslink between residues
  MOD_RES (5)..(5): Any amino acid available for cross-linking
XQALXEAGDEFELR

SEQ ID NO: 69 - protein, 22 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
LSPPVVHLXLALXQAGDDFSRR

SEQ ID NO: 70 - protein, 23 aa, Homo sapiens
  MOD_RES (9)..(9): Any amino acid available for cross-linking
  misc_feature (9)..(13): Crosslink between residues
  MOD_RES (13)..(13): Any amino acid available for cross-linking
EVIPMAAVXQALXEAGDEFELRY

SEQ ID NO: 71 - protein, 20 aa, Homo sapiens
  MOD_RES (6)..(6): Any amino acid available for cross-linking
  misc_feature (6)..(10): Crosslink between residues
  MOD_RES (10)..(10): Any amino acid available for cross-linking
PADPLXQAMXAAGDEFETRF

SEQ ID NO: 72 - protein, 23 aa, Homo sapiens
  MOD_RES (6)..(6): Any amino acid available for cross-linking
  misc_feature (6)..(10): Crosslink between residues
  MOD_RES (10)..(10): Any amino acid available for cross-linking
ATSRKXETLXRVGDGVQRNHETA

SEQ ID NO: 73 - protein, 19 aa, Homo sapiens
  MOD_RES (5)..(5): Any amino acid available for cross-linking
  misc_feature (5)..(9): Crosslink between residues
  MOD_RES (9)..(9): Any amino acid available for cross-linking
LAEVXTVLXRLGDELEQIR

SEQ ID NO: 74 - protein, 19 aa, Homo sapiens
  MOD_RES (7)..(7): Any amino acid available for cross-linking
  misc_feature (7)..(11): Crosslink between residues
  MOD_RES (11)..(11): Any amino acid available for cross-linking
MTVGELXRALXHENGSLDP

SEQ ID NO: 75 - protein, 22 aa, Homo sapiens
  MOD_RES (8)..(8): Any amino acid available for cross-linking
  misc_feature (8)..(12): Crosslink between residues
  MOD_RES (12)..(12): Any amino acid available for cross-linking
VVEGEKEXEALXKSADWVSDWS

SEQ ID NO: 76 - protein, 20 aa, Homo sapiens
  MOD_RES (7)..(7): Any amino acid available for cross-linking
  misc_feature (7)..(11): Crosslink between residues
  MOD_RES (11)..(11): Any amino acid available for cross-linking
SMARDPXRYLXIQGDDRMKL

SEQ ID NO: 77 - protein, 16 aa, Homo sapiens
LSQETFSDLWKLLPEN

SEQ ID NO: 78 - protein, 16 aa, Homo sapiens
  MOD_RES (9)..(9): Any amino acid available for cross-linking
  misc_feature (9)..(16): Crosslink between residues
  MOD_RES (16)..(16): Any amino acid available for cross-linking
LSQETFSDXWKLLPEX

SEQ ID NO: 79 - protein, 16 aa, Homo sapiens
  MOD_RES (5)..(5): Any amino acid available for cross-linking
  misc_feature (5)..(12): Crosslink between residues
  MOD_RES (12)..(12): Any amino acid available for cross-linking
LSQEXFSDLWKXLPEN

SEQ ID NO: 80 - protein, 16 aa, Homo sapiens
  MOD_RES (4)..(4): Any amino acid available for cross-linking
  misc_feature (4)..(11): Crosslink between residues
  MOD_RES (11)..(11): Any amino acid available for cross-linking
LSQXTFSDLWXLLPEN

SEQ ID NO: 81 - protein, 16 aa, Homo sapiens
  MOD_RES (7)..(7): Any amino acid available for cross-linking
  misc_feature (7)..(14): Crosslink between residues
  MOD_RES (14)..(14): Any amino acid available for cross-linking
LSQETFXDLWKLLXEN

SEQ ID NO: 82 - protein, 16 aa, Homo sapiens
  MOD_RES (7)..(7): Any amino acid available for cross-linking
  misc_feature (7)..(14): Crosslink between residues
  MOD_RES (14)..(14): Any amino acid available for cross-linking
QSQQTFXNLWRLLXQN

SEQ ID NO: 83 - protein, 8 aa, Homo sapiens
DRVYIHPF

SEQ ID NO: 84 - protein, 14 aa, Homo sapiens
EQRLGNQWAVGHLM

SEQ ID NO: 85 - protein, 9 aa, Homo sapiens
RPPGFSPFR

SEQ ID NO: 86 - protein, 10 aa, Homo sapiens
ISHKDMQLGR

SEQ ID NO: 87 - protein, 10 aa, Homo sapiens
ARASHLGLAR

SEQ ID NO: 88 - protein, 13 aa, Homo sapiens
SYSMEHFRWGKPV

SEQ ID NO: 89 - protein, 8 aa, Homo sapiens
  MOD_RES (3)..(3): Any amino acid available for cross-linking
  misc_feature (3)..(5): Crosslink between residues
  MOD_RES (5)..(5): Any amino acid available for cross-linking
DRXYXHPF

SEQ ID NO: 90 - protein, 14 aa, Homo sapiens
  MOD_RES (7)..(7): Any amino acid available for cross-linking
  misc_feature (7)..(14): Crosslink between residues
  MOD_RES (14)..(14): Any amino acid available for cross-linking
EQRLGNXWAVGHLX

SEQ ID NO: 91 - protein, 10 aa, Homo sapiens
  MOD_RES (4)..(4): Any amino acid available for cross-linking
  misc_feature (4)..(10): Crosslink between residues
  MOD_RES (10)..(10): Any amino acid available for cross-linking
RPPXFSPFRX

SEQ ID NO: 92 - protein, 11 aa, Homo sapiens
  MOD_RES (7)..(7): Any amino acid available for cross-linking
  misc_feature (7)..(11): Crosslink between residues
  MOD_RES (11)..(11): Any amino acid available for cross-linking
ISHKDMXLGRX

SEQ ID NO: 93 - protein, 11 aa, Homo sapiens
  MOD_RES (7)..(7): Any amino acid available for cross-linking
  misc_feature (7)..(11): Crosslink between residues
  MOD_RES (11)..(11): Any amino acid available for cross-linking
ARASHLXLARX

SEQ ID NO: 94 - protein, 13 aa, Homo sapiens
  MOD_RES (5)..(5): Any amino acid available for cross-linking
  misc_feature (5)..(10): Crosslink between residues
  MOD_RES (10)..(10): Any amino acid available for cross-linking
SYSMXHFRWXKPV

SEQ ID NO: 95 - protein, 21 aa, Artificial Sequence
  Description of Artificial Sequence: Synthetic peptide
  misc_feature (1)..(1): N-term acetylated
  MOD_RES (9)..(9): Alpha-Me S5 olefin amino acid
  misc_feature (9)..(13): Crosslink between residues
  MOD_RES (13)..(13): Alpha-Me S5 olefin amino acid
  misc_feature (21)..(21): C-term amidated
IWIAQELRXIGDXFNAYYARR

SEQ ID NO: 96 - protein, 21 aa, Artificial Sequence
  Description of Artificial Sequence: Synthetic peptide
  misc_feature (1)..(1): N-term acetylated
  MOD_RES (9)..(9): Alpha-Me S5 olefin amino acid
  misc_feature (9)..(13): Crosslink between residues
  MOD_RES (13)..(13): Alpha-Me S5 olefin amino acid
  misc_feature (21)..(21): C-term amidated
RWIAQALRXIGDXFNAFYARR

SEQ ID NO: 97 - protein, 16 aa, Artificial Sequence
  Description of Artificial Sequence: Synthetic peptide
  misc_feature (1)..(1): N-term acetylated
  MOD_RES (7)..(7): Alpha-Me R8 olefin amino acid
  misc_feature (7)..(14): Crosslink between residues
  MOD_RES (14)..(14): Alpha-Me S5 olefin amino acid
  misc_feature (21)..(21): C-term amidated
ASQQTFXNLWRLLXQN

SEQ ID NO: 98 - protein, 18 aa, Artificial Sequence
  Description of Artificial Sequence: Synthetic peptide
  misc_feature (1)..(1): N-term propionyl
  MOD_RES (9)..(9): Alpha-Me S5 olefin amino acid
  misc_feature (9)..(13): Crosslink between residues
  MOD_RES (11)..(11): Aib
  MOD_RES (13)..(13): Alpha-Me S5 olefin amino acid
  MOD_RES (14)..(14): Nle
  misc_feature (21)..(21): C-term amidated
RNIARHLAXVXDXLDRSI

SEQ ID NO: 99 - protein, 21 aa, Artificial Sequence
  Description of Artificial Sequence: Synthetic peptide
  misc_feature (1)..(1): N-term acetylated
  MOD_RES (9)..(9): Alpha-Me S5 olefin amino acid
  misc_feature (9)..(13): Crosslink between residues
  MOD_RES (13)..(13): Alpha-Me S5 olefin amino acid
  misc_feature (21)..(21): C-term amidated
RWIAQALRXIGNXFNAYYARR

SEQ ID NO: 100 - protein, 21 aa, Artificial Sequence
  Description of Artificial Sequence: Synthetic peptide
  misc_feature (1)..(1): N-term acetylated
  MOD_RES (9)..(9): Alpha-Me S5 olefin amino acid
  misc_feature (9)..(13): Crosslink between residues
  MOD_RES (13)..(13): Alpha-Me S5 olefin amino acid
  misc_feature (21)..(21): C-term amidated
IWIAQALRXIGNXFNAYYARR

SEQ ID NO: 101 - protein, 20320 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid or amino acid analog
  misc_feature (1001)..(1032): Cross-link between residues
  MOD_RES (1002)..(1011): Independently any natural or non-natural amino acid
  misc_feature (1002)..(1011): This region may encompass 0 to 10 residues, wherein some residues may be absent
  MOD_RES (1012)..(1021): Any natural or non-natural amino acid or amino acid analog
  misc_feature (1012)..(1021): This region may encompass 0 to 10 residues, wherein some residues may be absent
  MOD_RES (1022)..(1031): Independently any natural or non-natural amino acid
  misc_feature (1022)..(1031): This region may encompass 0 to 10 residues, wherein some residues may be absent
  MOD_RES (1032)..(1032): Any natural or non-natural amino acid or amino acid analog
  MOD_RES (1033)..(2032): Independently any natural or non-natural amino acid
  misc_feature (1033)..(2032): This region may encompass 1 to 1000 residues, wherein some residues may be absent
  MOD_RES (2033)..(3032): Independently any natural or non-natural amino acid
  misc_feature (2033)..(3032): This region may encompass 1 to 1000 residues, wherein some residues may be absent
  MOD_RES (3033)..(3033): Any natural or non-natural amino acid or amino acid analog
  misc_feature (3033)..(3064): Cross-link between residues
  MOD_RES (3034)..(3043): Independently any natural or non-natural amino acid
  misc_feature (3034)..(3043): This region may encompass 0 to 10 residues, wherein some residues may be absent
  MOD_RES (3044)..(3053): Any natural or non-natural amino acid or amino acid analog
  misc_feature (3044)..(3053): This region may encompass 0 to 10 residues, wherein some residues may be absent
  MOD_RES (3054)..(3063): Independently any natural or non-natural amino acid
  misc_feature (3054)..(3063): This region may encompass 0 to 10 residues, wherein some residues may be absent
  MOD_RES (3064)..(3064): Any natural or non-natural amino acid or amino acid analog
  MOD_RES (3065)..(4064): Independently any natural or non-natural amino acid
  misc_feature (3065)..(4064): This region may encompass 1 to 1000 residues, wherein some residues may be absent
  MOD_RES (4065)..(5064): Independently any natural or non-natural amino acid
  misc_feature (4065)..(5064): This region may encompass 1 to 1000 residues, wherein some residues may be absent
  MOD_RES (5065)..(5065): Any natural or non-natural amino acid or amino acid analog
  misc_feature (5065)..(5096): Cross-link between residues
  MOD_RES (5066)..(5075): Independently any natural or non-natural amino acid
  misc_feature (5066)..(5075): This region may encompass 0 to 10 residues, wherein some residues may be absent
  MOD_RES (5076)..(5085): Any natural or non-natural amino acid or amino acid analog
  misc_feature (5076)..(5085): This region may encompass 0 to 10 residues, wherein some residues may be absent
  MOD_RES (5086)..(5095): Independently any natural or non-natural amino acid
  misc_feature (5086)..(5095): This region may encompass 0 to 10 residues, wherein some residues may be absent
  MOD_RES (5096)..(5096): Any natural or non-natural amino acid or amino acid analog
  MOD_RES (5097)..(6096): Independently any natural or non-natural amino acid
  misc_feature (5097)..(6096): This region may encompass 1 to 1000 residues, wherein some residues may be absent
  MOD_RES (6097)..(7096): Independently any natural or non-natural amino acid
  misc_feature (6097)..(7096): This region may encompass 1 to 1000 residues, wherein some residues may be absent
  MOD_RES (7097)..(7097): Any natural or non-natural amino acid or amino acid analog
  misc_feature (7097)..(7128): Cross-link between residues
  MOD_RES (7098)..(7107): Independently any natural or non-natural amino acid
  misc_feature (7098)..(7107): This region may encompass 0 to 10 residues, wherein some residues may be absent
  MOD_RES (7108)..(7117): Any natural or non-natural amino acid or amino acid analog
  misc_feature (7108)..(7117): This region may encompass 0 to 10 residues, wherein some residues may be absent
  MOD_RES (7118)..(7127): Independently any natural or non-natural amino acid
  misc_feature (7118)..(7127): This region may encompass 0 to 10 residues, wherein some residues may be absent
  MOD_RES (7128)..(7128): Any natural or non-natural amino acid or amino acid analog
  MOD_RES (7129)..(8128): Independently any natural or non-natural amino acid
  misc_feature (7129)..(8128): This region may encompass 1 to 1000 residues, wherein some residues may be absent
  MOD_RES (8129)..(9128): Independently any natural or non-natural amino acid
  misc_feature (8129)..(9128): This region may encompass 1 to 1000 residues, wherein some residues may be absent
  MOD_RES (9129)..(9129): Any natural or non-natural amino acid or amino acid analog
  misc_feature (9129)..(9160): Cross-link between residues
  MOD_RES (9130)..(9139): Independently any natural or non-natural amino acid
  misc_feature (9130)..(9139): This region may encompass 0 to 10 residues, wherein some residues may be absent
  MOD_RES (9140)..(9149): Any natural or non-natural amino acid or amino acid analog
  misc_feature (9140)..(9149): This region may encompass 0 to 10 residues, wherein some residues may be absent
  MOD_RES (9150)..(9159): Independently any natural or non-natural amino acid
  misc_feature (9150)..(9159): This region may encompass 0 to 10 residues, wherein some residues may be absent
  MOD_RES (9160)..(9160): Any natural or non-natural amino acid or amino acid analog
  MOD_RES (9161)..(10160): Independently any natural or non-natural amino acid
  misc_feature (9161)..(10160): This region may encompass 1 to 1000 residues, wherein some residues may be absent
  MOD_RES (10161)..(11160): Independently any natural or non-natural amino acid
  misc_feature (10161)..(11160): This region may encompass 1 to 1000 residues, wherein some residues may be absent
  MOD_RES (11161)..(11161): Any natural or non-natural amino acid or amino acid analog
  misc_feature (11161)..(11192): Cross-link between residues
  MOD_RES (11162)..(11171): Independently any natural or non-natural amino acid
  misc_feature (11162)..(11171): This region may encompass 0 to 10 residues, wherein some residues may be absent
  MOD_RES (11172)..(11181): Any natural or non-natural amino acid or amino acid analog
  misc_feature (11172)..(11181): This region may encompass 0 to 10 residues, wherein some residues may be absent
  MOD_RES (11182)..(11191): Independently any natural or non-natural amino acid
  misc_feature (11182)..(11191): This region may encompass 0 to 10 residues, wherein some residues may be absent
  MOD_RES (11192)..(11192): Any natural or non-natural amino acid or amino acid analog
  MOD_RES (11193)..(12192): Independently any natural or non-natural amino acid
  misc_feature (11193)..(12192): This region may encompass 1 to 1000 residues, wherein some residues may be absent
  MOD_RES (12193)..(13192): Independently any natural or non-natural amino acid
  misc_feature (12193)..(13192): This region may encompass 1 to 1000 residues, wherein some residues may be absent
  MOD_RES (13193)..(13193): Any natural or non-natural amino acid or amino acid analog
  misc_feature (13193)..(13224): Cross-link between residues
  MOD_RES (13194)..(13203): Independently any natural or non-natural amino acid
  misc_feature (13194)..(13203): This region may encompass 0 to 10 residues, wherein some residues may be absent
  MOD_RES (13204)..(13213): Any natural or non-natural amino acid or amino acid analog
  misc_feature (13204)..(13213): This region may encompass 0 to 10 residues, wherein some residues may be absent
  MOD_RES (13214)..(13223): Independently any natural or non-natural amino acid
  misc_feature (13214)..(13223): This region may encompass 0 to 10 residues, wherein some residues may be absent
  MOD_RES (13224)..(13224): Any natural or non-natural amino acid or amino acid analog
  MOD_RES (13225)..(14224): Independently any natural or non-natural amino acid
  misc_feature (13225)..(14224): This region may encompass 1 to 1000 residues, wherein some residues may be absent
  MOD_RES (14225)..(15224): Independently any natural or non-natural amino acid
  misc_feature (14225)..(15224): This region may encompass 1 to 1000 residues, wherein some residues may be absent
  MOD_RES (15225)..(15225): Any natural or non-natural amino acid or amino acid analog
  misc_feature (15225)..(15256): Cross-link between residues
  MOD_RES (15226)..(15235): Independently any natural or non-natural amino acid
  misc_feature (15226)..(15235): This region may encompass 0 to 10 residues, wherein some residues may be absent
  MOD_RES (15236)..(15245): Any natural or non-natural amino acid or amino acid analog
  misc_feature (15236)..(15245): This region may encompass 0 to 10 residues, wherein some residues may be absent
  MOD_RES (15246)..(15255): Independently any natural or non-natural amino acid
  misc_feature (15246)..(15255): This region may encompass 0 to 10 residues, wherein some residues may be absent
  MOD_RES (15256)..(15256): Any natural or non-natural amino acid or amino acid analog
  MOD_RES (15257)..(16256): Independently any natural or non-natural amino acid
  misc_feature (15257)..(16256): This region may encompass 1 to 1000 residues, wherein some residues may be absent
  MOD_RES (16257)..(17256): Independently any natural or non-natural amino acid
  misc_feature (16257)..(17256): This region may encompass 1 to 1000 residues, wherein some residues may be absent
  MOD_RES (17257)..(17257): Any natural or non-natural amino acid or amino acid analog
  misc_feature (17257)..(17288): Cross-link between residues
  MOD_RES (17258)..(17267): Independently any natural or non-natural amino acid
  misc_feature (17258)..(17267): This region may encompass 0 to 10 residues, wherein some residues may be absent
  MOD_RES (17268)..(17277): Any natural or non-natural amino acid or amino acid analog
  misc_feature (17268)..(17277): This region may encompass 0 to 10 residues, wherein some residues may be absent
  MOD_RES (17278)..(17287): Independently any natural or non-natural amino acid
  misc_feature (17278)..(17287): This region may encompass 0 to 10 residues, wherein some residues may be absent
  MOD_RES (17288)..(17288): Any natural or non-natural amino acid or amino acid analog
  MOD_RES (17289)..(18288): Independently any natural or non-natural amino acid
  misc_feature (17289)..(18288): This region may encompass 1 to 1000 residues, wherein some residues may be absent
  MOD_RES (18289)..(19288): Independently any natural or non-natural amino acid
  misc_feature (18289)..(19288): This region may encompass 1 to 1000 residues, wherein some residues may be absent
  MOD_RES (19289)..(19289): Any natural or non-natural amino acid or amino acid analog
  misc_feature (19289)..(19320): Cross-link between residues
  MOD_RES (19290)..(19299): Independently any natural or non-natural amino acid
  misc_feature (19290)..(19299): This region may encompass 0 to 10 residues, wherein some residues may be absent
  MOD_RES (19300)..(19309): Any natural or non-natural amino acid or amino acid analog
  misc_feature (19300)..(19309): This region may encompass 0 to 10 residues, wherein some residues may be absent
  MOD_RES (19310)..(19319): Independently any natural or non-natural amino acid
  misc_feature (19310)..(19319): This region may encompass 0 to 10 residues, wherein some residues may be absent
  MOD_RES (19320)..(19320): Any natural or non-natural amino acid or amino acid analog
  MOD_RES (19321)..(20320): Independently any natural or non-natural amino acid
  misc_feature (19321)..(20320): This region may encompass 1 to 1000 residues, wherein some residues may be absent
  misc_feature (1)..(20320): This sequence may encompass 1 to 10 repeats of the region encompassed by residues 1 to 2032
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 102 - protein, 2007 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1007): Any natural or non-natural amino acid or amino acid analog
  misc_feature (1002)..(1006): Cross-link between residues
  MOD_RES (1008)..(2007): Independently any natural or non-natural amino acid
  misc_feature (1008)..(2007): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 103 - protein, 2007 aa, Artificial Sequence; identical to SEQ ID NO: 102
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1007): Any natural or non-natural amino acid or amino acid analog
  misc_feature (1002)..(1006): Cross-link between residues
  MOD_RES (1008)..(2007): Independently any natural or non-natural amino acid
  misc_feature (1008)..(2007): This region may encompass 1 to 1000 residues, wherein some residues may be absent
  see specification as filed for detailed description of substitutions and preferred embodiments

SEQ ID NO: 104 - protein, 2007 aa, Artificial Sequence; identical to SEQ ID NO: 102
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1007): Any natural or non-natural amino acid or amino acid analog
  misc_feature (1002)..(1006): Cross-link between residues
  MOD_RES (1008)..(2007): Independently any natural or non-natural amino acid
  misc_feature (1008)..(2007): This region may encompass 1 to 1000 residues, wherein some residues may be absent
  see specification as filed for detailed description of substitutions and preferred embodiments

SEQ ID NO: 105 - protein, 2007 aa, Artificial Sequence; identical to SEQ ID NO: 102
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1006): Cross-link between residues
  MOD_RES (1003)..(1005): Any natural or non-natural amino acid
  MOD_RES (1006)..(1006): Any natural or non-natural amino acid or amino acid analog
  MOD_RES (1007)..(1007): Any natural or non-natural amino acid
  MOD_RES (1008)..(2007): Independently any natural or non-natural amino acid
  misc_feature (1008)..(2007): This region may encompass 1 to 1000 residues, wherein some residues may be absent
  see specification as filed for detailed description of substitutions and preferred embodiments

SEQ ID NO: 106 - protein, 2010 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1009): Cross-link between residues
  MOD_RES (1003)..(1008): Any natural or non-natural amino acid
  MOD_RES (1009)..(1009): Any natural or non-natural amino acid or amino acid analog
  MOD_RES (1010)..(1010): Any natural or non-natural amino acid
  MOD_RES (1011)..(2010): Independently any natural or non-natural amino acid
  misc_feature (1011)..(2010): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 107 - protein, 1005 aa, Artificial Sequence
  Description of Artificial Sequence: Synthetic polypeptide
  MOD_RES (1)..(5): Any natural or non-natural amino acid
  misc_feature (1)..(3): Cross-link between the residue at position 3 and the modified N-term of the sequence
  MOD_RES (6)..(1005): Independently any natural or non-natural amino acid
  misc_feature (6)..(1005): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 108 - protein, 1509 aa, Artificial Sequence
  Description of Artificial Sequence: Synthetic polypeptide
  MOD_RES (1)..(3): Any natural or non-natural amino acid
  misc_feature (1)..(3): Cross-link between the residue at position 3 and the modified N-term of the sequence
  MOD_RES (4)..(503): Any natural or non-natural amino acid
  misc_feature (4)..(503): This region may encompass 0, 20, 50, 100, 200, 300, 400 or 500 residues, wherein some residues may be absent
  MOD_RES (504)..(504): Any natural or non-natural amino acid or amino acid analog
  misc_feature (504)..(508): Cross-link between residues
  MOD_RES (505)..(507): Any natural or non-natural amino acid
  MOD_RES (508)..(508): Any natural or non-natural amino acid or amino acid analog
  MOD_RES (509)..(509): Any natural or non-natural amino acid
  MOD_RES (510)..(1509): Independently any natural or non-natural amino acid
  misc_feature (510)..(1509): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 109 - protein, 1512 aa, Artificial Sequence
  Description of Artificial Sequence: Synthetic polypeptide
  MOD_RES (1)..(3): Any natural or non-natural amino acid
  misc_feature (1)..(3): Cross-link between the residue at position 3 and the modified N-term of the sequence
  MOD_RES (4)..(503): Any natural or non-natural amino acid
  misc_feature (4)..(503): This region may encompass 0, 20, 50, 100, 200, 300, 400 or 500 residues, wherein some residues may be absent
  MOD_RES (504)..(504): Any natural or non-natural amino acid or amino acid analog
  misc_feature (504)..(511): Cross-link between residues
  MOD_RES (505)..(510): Any natural or non-natural amino acid
  MOD_RES (511)..(511): Any natural or non-natural amino acid or amino acid analog
  MOD_RES (512)..(512): Any natural or non-natural amino acid
  MOD_RES (513)..(1512): Independently any natural or non-natural amino acid
  misc_feature (513)..(1512): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 110 - protein, 2512 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1006): Cross-link between residues
  MOD_RES (1003)..(1005): Any natural or non-natural amino acid
  MOD_RES (1006)..(1006): Any natural or non-natural amino acid or amino acid analog
  MOD_RES (1007)..(1506): Any natural or non-natural amino acid
  misc_feature (1007)..(1506): This region may encompass 0, 20, 50, 100, 200, 300, 400 or 500 residues, wherein some residues may be absent
  MOD_RES (1507)..(1507): Any natural or non-natural amino acid or amino acid analog
  misc_feature (1507)..(1511): Cross-link between residues
  MOD_RES (1508)..(1510): Any natural or non-natural amino acid
  MOD_RES (1511)..(1511): Any natural or non-natural amino acid or amino acid analog
  MOD_RES (1512)..(1512): Any natural or non-natural amino acid
  MOD_RES (1513)..(2512): Independently any natural or non-natural amino acid
  misc_feature (1513)..(2512): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 111 - protein, 2515 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1009): Cross-link between residues
  MOD_RES (1003)..(1008): Any natural or non-natural amino acid
  MOD_RES (1009)..(1009): Any natural or non-natural amino acid or amino acid analog
  MOD_RES (1010)..(1509): Any natural or non-natural amino acid
  misc_feature (1010)..(1509): This region may encompass 0, 20, 50, 100, 200, 300, 400 or 500 residues, wherein some residues may be absent
  MOD_RES (1510)..(1510): Any natural or non-natural amino acid or amino acid analog
  misc_feature (1510)..(1514): Cross-link between residues
  MOD_RES (1511)..(1513): Any natural or non-natural amino acid
  MOD_RES (1514)..(1514): Any natural or non-natural amino acid or amino acid analog
  MOD_RES (1515)..(1515): Any natural or non-natural amino acid
  MOD_RES (1516)..(2515): Independently any natural or non-natural amino acid
  misc_feature (1516)..(2515): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 112 - protein, 2515 aa, Artificial Sequence; identical to SEQ ID NO: 111
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1006): Cross-link between residues
  MOD_RES (1003)..(1005): Any natural or non-natural amino acid
  MOD_RES (1006)..(1006): Any natural or non-natural amino acid or amino acid analog
  MOD_RES (1007)..(1506): Any natural or non-natural amino acid
  misc_feature (1007)..(1506): This region may encompass 0, 20, 50, 100, 200, 300, 400 or 500 residues, wherein some residues may be absent
  MOD_RES (1507)..(1507): Any natural or non-natural amino acid or amino acid analog
  misc_feature (1507)..(1514): Cross-link between residues
  MOD_RES (1508)..(1513): Any natural or non-natural amino acid
  MOD_RES (1514)..(1514): Any natural or non-natural amino acid or amino acid analog
  MOD_RES (1515)..(1515): Any natural or non-natural amino acid
  MOD_RES (1516)..(2515): Independently any natural or non-natural amino acid
  misc_feature (1516)..(2515): This region may encompass 1 to 1000 residues, wherein some residues may be absent
  see specification as filed for detailed description of substitutions and preferred embodiments

SEQ ID NO: 113 - protein, 2516 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid or amino acid analog
  misc_feature (1001)..(1008): Cross-link between residues
  MOD_RES (1002)..(1007): Any natural or non-natural amino acid
  MOD_RES (1008)..(1008): Any natural or non-natural amino acid or amino acid analog
  MOD_RES (1009)..(1508): Any natural or non-natural amino acid
  misc_feature (1009)..(1508): This region may encompass 0, 20, 50, 100, 200, 300, 400 or 500 residues, wherein some residues may be absent
  MOD_RES (1509)..(1509): Any natural or non-natural amino acid or amino acid analog
  misc_feature (1509)..(1516): Cross-link between residues
  MOD_RES (1510)..(1515): Any natural or non-natural amino acid
  MOD_RES (1516)..(1516): Any natural or non-natural amino acid or amino acid analog
  MOD_RES (1517)..(2516): Independently any natural or non-natural amino acid
  misc_feature (1517)..(2516): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 114 - protein, 2014 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1006): Cross-link between residues
  MOD_RES (1003)..(1005): Any natural or non-natural amino acid
  MOD_RES (1006)..(1006): Any natural or non-natural amino acid or amino acid analog
  misc_feature (1006)..(1013): Cross-link between residues
  MOD_RES (1007)..(1012): Any natural or non-natural amino acid
  MOD_RES (1013)..(1013): Any natural or non-natural amino acid or amino acid analog
  MOD_RES (1014)..(1014): Any natural or non-natural amino acid
  MOD_RES (1015)..(2014): Independently any natural or non-natural amino acid
  misc_feature (1015)..(2014): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 115 - protein, 2011 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1006): Cross-link between residues
  MOD_RES (1003)..(1005): Any natural or non-natural amino acid
  MOD_RES (1006)..(1006): Any natural or non-natural amino acid or amino acid analog
  misc_feature (1006)..(1010): Cross-link between residues
  MOD_RES (1007)..(1009): Any natural or non-natural amino acid
  MOD_RES (1010)..(1010): Any natural or non-natural amino acid or amino acid analog
  MOD_RES (1011)..(1011): Any natural or non-natural amino acid
  MOD_RES (1012)..(2011): Independently any natural or non-natural amino acid
  misc_feature (1012)..(2011): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 116 - protein, 2014 aa, Artificial Sequence; identical to SEQ ID NO: 114
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid
  MOD_RES (1002)..(1002): Any natural or non-natural amino acid or amino acid analog
  misc_feature (1002)..(1009): Cross-link between residues
  MOD_RES (1003)..(1008): Any natural or non-natural amino acid
  MOD_RES (1009)..(1009): Any natural or non-natural amino acid or amino acid analog
  misc_feature (1009)..(1013): Cross-link between residues
  MOD_RES (1010)..(1012): Any natural or non-natural amino acid
  MOD_RES (1013)..(1013): Any natural or non-natural amino acid or amino acid analog
  MOD_RES (1014)..(1014): Any natural or non-natural amino acid
  MOD_RES (1015)..(2014): Independently any natural or non-natural amino acid
  misc_feature (1015)..(2014): This region may encompass 1 to 1000 residues, wherein some residues may be absent
  see specification as filed for detailed description of substitutions and preferred embodiments

SEQ ID NO: 117 - protein, 2015 aa, Artificial Sequence
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid or amino acid analog
  misc_feature (1001)..(1008): Cross-link between residues
  MOD_RES (1002)..(1007): Any natural or non-natural amino acid
  MOD_RES (1008)..(1008): Any natural or non-natural amino acid or amino acid analog
  misc_feature (1008)..(1015): Cross-link between residues
  MOD_RES (1009)..(1014): Any natural or non-natural amino acid
  MOD_RES (1015)..(1015): Any natural or non-natural amino acid or amino acid analog
  MOD_RES (1016)..(2015): Independently any natural or non-natural amino acid
  misc_feature (1016)..(2015): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 118 - protein, 1032 aa, Artificial Sequence
  Description of Artificial Sequence: Synthetic polypeptide
  MOD_RES (1)..(1): Any natural or non-natural amino acid or amino acid analog
  misc_feature (1)..(32): Cross-link between residues
  MOD_RES (2)..(11): Independently any natural or non-natural amino acid
  misc_feature (2)..(11): This region may encompass 0 to 10 residues, wherein some residues may be absent
  MOD_RES (12)..(21): Any natural or non-natural amino acid or amino acid analog
  misc_feature (12)..(21): This region may encompass 0 to 10 residues, wherein some residues may be absent
  MOD_RES (22)..(31): Independently any natural or non-natural amino acid
  misc_feature (22)..(31): This region may encompass 0 to 10 residues, wherein some residues may be absent
  MOD_RES (32)..(32): Any natural or non-natural amino acid or amino acid analog
  MOD_RES (33)..(1032): Independently any natural or non-natural amino acid
  misc_feature (33)..(1032): This region may encompass 1 to 1000 residues, wherein some residues may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 119 - protein, 20320 aa, Artificial Sequence; identical to SEQ ID NO: 101
  Description of Artificial Sequence: Synthetic polypeptide
  MOD_RES (1)..(1000): Independently any natural or non-natural amino acid
  misc_feature (1)..(1000): This region may encompass 1 to 1000 residues, wherein some residues may be absent
  MOD_RES (1001)..(1001): Any natural or non-natural amino acid or amino acid analog
  misc_feature (1001)..(1032): Cross-link between residues
  MOD_RES (1002)..(1011): Independently any natural or non-natural amino acid
  misc_feature (1002)..(1011): This region may encompass 0 to 10 residues, wherein some residues may be absent
  MOD_RES (1012)..(1021): Any natural or non-natural amino acid or amino acid analog
  misc_feature (1012)..(1021): This region may encompass 0 to 10 residues, wherein some residues may be absent
  MOD_RES (1022)..(1031): Independently any natural or non-natural amino acid
  misc_feature (1022)..(1031): This region may encompass 0 to 10 residues, wherein some residues may be absent
  MOD_RES (1032)..(1032): Any natural or non-natural amino acid or amino acid analog
  MOD_RES (1033)..(2032): Independently any natural or non-natural amino acid
  misc_feature (1033)..(2032): This region may encompass 1 to 1000 residues, wherein some residues may be absent
  MOD_RES (2033)..(3032): Independently any natural or non-natural amino acid
  misc_feature (2033)..(3032): This region may encompass 1 to 1000 residues, wherein some residues may be absent
  MOD_RES (3033)..(3033): Any natural or non-natural amino acid or amino acid analog
  misc_feature (3033)..(3064): Cross-link between residues
  MOD_RES (3034)..(3043): Independently any natural or non-natural amino acid
  misc_feature (3034)..(3043): This region may encompass 0 to 10 residues, wherein some residues may be absent
  MOD_RES (3044)..(3053): Any natural or non-natural amino acid or amino acid analog
  misc_feature (3044)..(3053): This region may encompass 0 to 10 residues, wherein some residues may be absent
  MOD_RES (3054)..(3063): Independently any natural or non-natural amino acid
  misc_feature (3054)..(3063): This region may encompass 0 to 10 residues, wherein some residues may be absent
  MOD_RES (3064)..(3064): Any natural or non-natural amino acid or amino acid analog
  MOD_RES (3065)..(4064): Independently any natural or non-natural amino acid
  misc_feature (3065)..(4064): This region may encompass 1 to 1000 residues, wherein some residues may be absent
  MOD_RES (4065)..(5064): Independently any natural or non-natural amino acid
  misc_feature (4065)..(5064): This region may encompass 1 to 1000 residues, wherein some residues may be absent
  MOD_RES (5065)..(5065): Any natural or non-natural amino acid or amino acid analog
  misc_feature (5065)..(5096): Cross-link between residues
  MOD_RES (5066)..(5075): Independently any natural or non-natural amino acid
  misc_feature (5066)..(5075): This region may encompass 0 to 10 residues, wherein some residues may be absent
  MOD_RES (5076)..(5085): Any natural or non-natural amino acid or amino acid analog
  misc_feature (5076)..(5085): This region may encompass 0 to 10 residues, wherein some residues may be absent
  MOD_RES (5086)..(5095): Independently any natural or non-natural amino acid
  misc_feature (5086)..(5095): This region may encompass 0 to 10 residues, wherein some residues may be absent
  MOD_RES (5096)..(5096): Any natural or non-natural amino acid or amino acid analog
  MOD_RES (5097)..(6096): Independently any natural or non-natural amino acid
  misc_feature (5097)..(6096): This region may encompass 1 to 1000 residues, wherein some residues may be absent
  MOD_RES (6097)..(7096): Independently any natural or non-natural amino acid
  misc_feature (6097)..(7096): This region may encompass 1 to 1000 residues, wherein some residues may be absent
  MOD_RES (7097)..(7097): Any natural or non-natural amino acid or amino acid analog
  misc_feature (7097)..(7128): Cross-link between residues
  MOD_RES (7098)..(7107): Independently any natural or non-natural amino acid
  misc_feature (7098)..(7107): This region may encompass 0 to 10 residues, wherein some residues may be absent
  MOD_RES (7108)..(7117): Any natural or non-natural amino acid or amino acid analog
  misc_feature (7108)..(7117): This region may encompass 0 to 10 residues, wherein some residues may be absent
  MOD_RES (7118)..(7127): Independently any natural or non-natural amino acid
  misc_feature (7118)..(7127): This region may encompass 0 to 10 residues, wherein some residues may be absent
  MOD_RES (7128)..(7128): Any natural or non-natural amino acid or amino acid analog
  MOD_RES (7129)..(8128): Independently any natural or non-natural amino acid
  misc_feature (7129)..(8128): This region may encompass 1 to 1000 residues, wherein some residues may be absent
  MOD_RES (8129)..(9128): Independently any natural or non-natural amino acid
  misc_feature (8129)..(9128): This region may encompass 1 to 1000 residues, wherein some residues may be absent
  MOD_RES (9129)..(9129): Any natural or non-natural amino acid or amino acid analog
  misc_feature (9129)..(9160): Cross-link between residues
  MOD_RES (9130)..(9139): Independently any natural or non-natural amino acid
  misc_feature (9130)..(9139): This region may encompass 0 to 10 residues, wherein some residues may be absent
  MOD_RES (9140)..(9149): Any natural or non-natural amino acid or amino acid analog
  misc_feature (9140)..(9149): This region may encompass 0 to 10 residues, wherein some residues may be absent
  MOD_RES (9150)..(9159): Independently any natural or non-natural amino acid
  misc_feature (9150)..(9159): This region may encompass 0 to 10 residues, wherein some residues may be absent
  MOD_RES (9160)..(9160): Any natural or non-natural amino acid or amino acid analog
  MOD_RES (9161)..(10160): Independently any natural or non-natural amino acid
  misc_feature (9161)..(10160): This region may encompass 1 to 1000 residues, wherein some residues may be absent
  MOD_RES (10161)..(11160): Independently any natural or non-natural amino acid
  misc_feature (10161)..(11160): This region may encompass 1 to 1000 residues, wherein some residues may be absent
  MOD_RES (11161)..(11161): Any natural or non-natural amino acid or amino acid analog
  misc_feature (11161)..(11192): Cross-link between residues
  MOD_RES (11162)..(11171): Independently any natural or non-natural amino acid
  misc_feature (11162)..(11171): This region may encompass 0 to 10 residues, wherein some residues may be absent
  MOD_RES (11172)..(11181): Any natural or non-natural amino acid or amino acid analog
  misc_feature (11172)..(11181): This region may encompass 0 to 10 residues, wherein some residues may be absent
  MOD_RES (11182)..(11191): Independently any natural or non-natural amino acid
  misc_feature (11182)..(11191): This region may encompass 0 to 10 residues, wherein some residues may be absent
  MOD_RES (11192)..(11192): Any natural or non-natural amino acid or amino acid analog
  MOD_RES (11193)..(12192): Independently any natural or non-natural amino acid
  misc_feature (11193)..(12192): This region may encompass 1 to 1000 residues, wherein some residues may be absent
  MOD_RES (12193)..(13192): Independently any natural or non-natural amino acid
  misc_feature (12193)..(13192): This region may encompass 1 to 1000 residues, wherein some residues may be absent
  MOD_RES (13193)..(13193): Any natural or non-natural amino acid or amino acid analog
  misc_feature (13193)..(13224): Cross-link between residues
  MOD_RES (13194)..(13203): Independently any natural or non-natural amino acid
  misc_feature (13194)..(13203): This region may encompass 0 to 10 residues, wherein some residues may be absent
  MOD_RES (13204)..(13213): Any natural or non-natural amino acid or amino acid analog
  misc_feature (13204)..(13213): This region may encompass 0 to 10 residues, wherein some residues may be absent
  MOD_RES (13214)..(13223): Independently any natural or non-natural amino acid
  misc_feature (13214)..(13223): This region may encompass 0 to 10 residues, wherein some residues may be absent
  MOD_RES (13224)..(13224): Any natural or non-natural amino acid or amino acid analog
  MOD_RES (13225)..(14224): Independently any natural or non-natural amino acid
  misc_feature (13225)..(14224): This region may encompass 1 to 1000 residues, wherein some residues may be absent
  MOD_RES (14225)..(15224): Independently any natural or non-natural amino acid
  misc_feature (14225)..(15224): This region may encompass 1 to 1000 residues, wherein some residues may be absent
  MOD_RES (15225)..(15225): Any natural or non-natural amino acid or amino acid analog
  misc_feature (15225)..(15256): Cross-link between residues
  MOD_RES (15226)..(15235): Independently any natural or non-natural amino acid
  misc_feature (15226)..(15235): This region may encompass 0 to 10 residues, wherein some residues may be absent
  MOD_RES (15236)..(15245): Any natural or non-natural amino acid or amino acid analog
  misc_feature (15236)..(15245): This region may encompass 0 to 10 residues, wherein some residues may be absent
  MOD_RES (15246)..(15255): Independently any natural or non-natural amino acid
  misc_feature (15246)..(15255): This region may encompass 0 to 10 residues, wherein some residues may be absent
  MOD_RES (15256)..(15256): Any natural or non-natural amino acid or amino acid analog
  MOD_RES (15257)..(16256): Independently any natural or non-natural amino acid
  misc_feature (15257)..(16256): This region may encompass 1 to 1000 residues, wherein some residues may be absent
  MOD_RES (16257)..(17256): Independently any natural or non-natural amino acid
  misc_feature (16257)..(17256): This region may encompass 1 to 1000 residues, wherein some residues may be absent
  MOD_RES (17257)..(17257): Any natural or non-natural amino acid or amino acid analog
  misc_feature (17257)..(17288): Cross-link between residues
  MOD_RES (17258)..(17267): Independently any natural or non-natural amino acid
  misc_feature (17258)..(17267): This region may encompass 0 to 10 residues, wherein some residues may be absent
  MOD_RES (17268)..(17277): Any natural or non-natural amino acid or amino acid analog
  misc_feature (17268)..(17277): This region may encompass 0 to 10 residues, wherein some residues may be absent
  MOD_RES (17278)..(17287): Independently any natural or non-natural amino acid
  misc_feature (17278)..(17287): This region may encompass 0 to 10 residues, wherein some residues may be absent
  MOD_RES (17288)..(17288): Any natural or non-natural amino acid or amino acid analog
  MOD_RES (17289)..(18288): Independently any natural or non-natural amino acid
  misc_feature (17289)..(18288): This region may encompass 1 to 1000 residues, wherein some residues may be absent
  MOD_RES (18289)..(19288): Independently any natural or non-natural amino acid
  misc_feature (18289)..(19288): This region may encompass 1 to 1000 residues, wherein some residues may be absent
  MOD_RES (19289)..(19289): Any natural or non-natural amino acid or amino acid analog
  misc_feature (19289)..(19320): Cross-link between residues
  MOD_RES (19290)..(19299): Independently any natural or non-natural amino acid
  misc_feature (19290)..(19299): This region may encompass 0 to 10 residues, wherein some residues may be absent
  MOD_RES (19300)..(19309): Any natural or non-natural amino acid or amino acid analog
  misc_feature (19300)..(19309): This region may encompass 0 to 10 residues, wherein some residues may be absent
  MOD_RES (19310)..(19319): Independently any natural or non-natural amino acid
  misc_feature (19310)..(19319): This region may encompass 0 to 10 residues, wherein some residues may be absent
  MOD_RES (19320)..(19320): Any natural or non-natural amino acid or amino acid analog
  MOD_RES (19321)..(20320): Independently any natural or non-natural amino acid
  misc_feature (19321)..(20320): This region may encompass 1 to 1000 residues, wherein some residues may be absent
  misc_feature (1)..(20320): This sequence may encompass 1 to 10 repeats of the region encompassed by residues 1 to 2032
  see specification as filed for detailed description of substitutions and preferred embodiments

What is claimed is:

1. A method for preparing a pharmaceutical composition comprising a purified peptidomimetic macrocycle comprising an alpha-helix, the method comprising:
    a) contacting a peptidomimetic precursor attached to a solid support comprising at least two moieties capable of undergoing a metathesis reaction with a metathesis catalyst comprising a metal to produce a crude peptidomimetic macrocycle comprising a cross-linker connecting a first amino acid and a second amino acid, the cross-linker spanning from 1 turn to 5 turns of the alpha-helix;
    b) purifying the crude peptidomimetic macrocycle to result in a purified peptidomimetic macrocycle composition comprising less than 10 ppm by weight of the metal from the metathesis catalyst, wherein said purifying comprises the step of washing said crude peptidomimetic macrocycle with a solvent prior to removing said crude peptidomimetic macrocycle from the solid support; and
    c) formulating the purified peptidomimetic macrocycle composition into the pharmaceutical composition for administration to a human subject.

2. The method of claim 1, wherein said purifying step comprises washing with DMSO.

3. The method of claim 2, wherein following said washing, said purifying step further comprises at least two chromatographic purification steps.

4. The method of claim 1, wherein the purification step does not involve crystallization.

5. The method of claim 1 wherein the purified peptidomimetic macrocycle composition comprises less than 5 ppm by weight of the metal.

6. The method of claim 1, wherein the purified peptidomimetic macrocycle comprises an alpha-helical domain of a BCL-2 family member.

7. The method of claim 1, wherein the purified peptidomimetic macrocycle comprises a ring of 18 atoms to 26 atoms, or of 29 atoms to 37 atoms.

8. The method of claim 1, wherein the purified peptidomimetic macrocycle carries a net positive charge at pH 7.4.

9. The method of claim 1, wherein the first amino acid and the second amino acid are separated by three or six amino acids.

10. The method of claim 1, wherein the crosslinker comprises between 6 and 14 consecutive bonds, or between 8 and 16 consecutive bonds.

11. The method of claim 1, wherein the crosslinker comprises a length of about 5 Å to about 9 Å per turn of the alpha-helix.

12. The method of claim 1, wherein an alpha position of the first or second amino acid is additionally substituted.

13. The method of claim 1 wherein the peptidomimetic macrocycle comprises moieties comprising one or more of a therapeutic agent, halogen, alkyl group, a fluorescent moiety, affinity label, targeting moiety, or a radioisotope.

14. The method of claim 1 wherein the purified peptidomimetic macrocycle composition comprises a metal at a concentration greater than or equal to 0.5 ppm by weight.

15. The method of claim 1 wherein the metathesis catalyst comprises a ruthenium or osmium catalyst.

16. The method of claim 1 wherein the metathesis catalyst comprises one or more substituents selected from the group consisting of iodine, bromine, chlorine, phenyl, carbene, cyclohexyl, phosphine, tricyclohexylphosphine, imidazole, or a benzylidene.

17. The method of claim 1 wherein the peptidomimetic precursor is bound to a solid support.

18. The method of claim 1 wherein the metathesis catalyst is bound to a solid support.

19. The method of claim 1 wherein the peptidomimetic macrocycle composition comprises a pharmaceutically acceptable salt of the peptidomimetic macrocycle.

20. The method of claim 1 wherein the purified peptidomimetic macrocycle composition can be safely administered to a subject.

21. The method of claim 3, wherein at least one of said two chromatographic purification steps is HPLC.

22. The method of claim 1, wherein the purified peptidomimetic macrocycle comprises a BH3 domain.

23. The method of claim 1, wherein the purified peptidomimetic macrocycle composition comprises less than 1 ppm by weight of the metal.

24. A method for preparing a pharmaceutical composition comprising a purified peptidomimetic macrocycle comprising an alpha-helix, the method comprising:
  a) contacting a peptidomimetic precursor attached to a solid support comprising at least two moieties capable of undergoing a metathesis reaction with a metathesis catalyst comprising ruthenium to produce a crude peptidomimetic macrocycle comprising a cross-linker connecting a first amino acid and a second amino acid, the cross-linker spanning from 1 turn to 5 turns of the alpha-helix;
  b) purifying the crude peptidomimetic macrocycle to result in a purified peptidomimetic macrocycle composition comprising less than 10 ppm by weight of ruthenium from the metathesis catalyst, wherein said purifying comprises the step of washing said crude peptidomimetic macrocycle with a solvent prior to removing said crude peptidomimetic macrocycle from the solid support; and
  c) formulating the purified peptidomimetic macrocycle composition into the pharmaceutical composition for administration to a human subject.

25. The method of claim 24, wherein said purifying step comprises washing with DMSO.

26. The method of claim 25 wherein following said washing, said purifying step further comprises at least two chromatographic purification steps.

27. The method of claim 24, wherein the purification step does not involve crystallization.

28. The method of claim 24 wherein the purified peptidomimetic macrocycle composition comprises less than 5 ppm by weight of ruthenium.

29. The method of claim 24, wherein the purified peptidomimetic macrocycle comprises an alpha-helical domain of a BCL-2 family member.

30. The method of claim 24, wherein the purified peptidomimetic macrocycle comprises a ring of 18 atoms to 26 atoms, or of 29 atoms to 37 atoms.

31. The method of claim 24, wherein the purified peptidomimetic macrocycle carries a net positive charge at pH 7.4.

32. The method of claim 24, wherein the first amino acid and the second amino acid are separated by three or six amino acids.

33. The method of claim 24, wherein the crosslinker comprises between 6 and 14 consecutive bonds, or between 8 and 16 consecutive bonds.

34. The method of claim 24, wherein the crosslinker comprises a length of about 5 Å to about 9 Å per turn of the alpha-helix.

35. The method of claim 24, wherein an alpha position of the first or second amino acid is additionally substituted.

36. The method of claim 24 wherein the peptidomimetic macrocycle comprises moieties comprising one or more of a therapeutic agent, halogen, alkyl group, a fluorescent moiety, affinity label, targeting moiety, or a radioisotope.

37. The method of claim 24, wherein the purified peptidomimetic macrocycle composition comprises ruthenium at a concentration greater than or equal to 0.5 ppm by weight.

38. The method of claim 24 wherein the metathesis catalyst comprises one or more substituents selected from the group consisting of iodine, bromine, chlorine, phenyl, carbene, cyclohexyl, phosphine, tricyclohexylphosphine, imidazole, or a benzylidene.

39. The method of claim 24 wherein the peptidomimetic precursor is bound to a solid support.

40. The method of claim 24 wherein the metathesis catalyst is bound to a solid support.

41. The method of claim 24 wherein the peptidomimetic macrocycle composition comprises a pharmaceutically acceptable salt of the peptidomimetic macrocycle.

42. The method of claim 24 wherein the purified peptidomimetic macrocycle composition can be safely administered to a subject.

43. The method of claim 26, wherein at least one of said two chromatographic purification steps is HPLC.

44. The method of claim 24, wherein the purified peptidomimetic macrocycle comprises a BH3 domain.

45. The method of claim 24, wherein the purified peptidomimetic macrocycle composition comprises less than 1 ppm by weight of ruthenium.

46. The method of claim 1 or 24, wherein the purified peptidomimetic macrocycle composition is a therapeutic agent.

47. The method of claim 19 or 41, wherein the pharmaceutically acceptable salt of the peptidomimetic macrocycle is a hydrochloric acid or an acetate salt.

* * * * *